US008247192B2

(12) United States Patent
Behrouzian et al.

(10) Patent No.: US 8,247,192 B2
(45) Date of Patent: Aug. 21, 2012

(54) PENICILLIN-G ACYLASES

(75) Inventors: Behnaz Behrouzian, Sunnyvale, CA (US); Anke Krebber, Palo Alto, CA (US); Emily Mundorff, Belmont, CA (US)

(73) Assignee: Codexis, Inc., Redwood, CA (US)

( * ) Notice: Subject to any disclaimer, the term of this patent is extended or adjusted under 35 U.S.C. 154(b) by 473 days.

(21) Appl. No.: 12/615,139

(22) Filed: Nov. 9, 2009

(65) Prior Publication Data
US 2010/0143968 A1 Jun. 10, 2010

Related U.S. Application Data

(60) Provisional application No. 61/113,224, filed on Nov. 10, 2008.

(51) Int. Cl.
C12P 37/06 (2006.01)
C12N 15/55 (2006.01)
C12N 9/84 (2006.01)

(52) U.S. Cl. .... 435/44; 435/230; 435/320.1; 435/252.3; 435/325; 536/23.2

(58) Field of Classification Search .................. None
See application file for complete search history.

(56) References Cited

U.S. PATENT DOCUMENTS

| | | | |
|---|---|---|---|
| 5,457,032 | A | 10/1995 | Quax et al. |
| 5,891,703 | A | 4/1999 | Van Der Laan et al. |
| 6,033,823 | A | 3/2000 | Van Der Laan et al. |
| 6,117,679 | A | 9/2000 | Stemmer |
| 6,376,246 | B1 | 4/2002 | Crameri et al. |
| 6,586,182 | B1 | 7/2003 | Patten et al. |
| 2005/0124029 | A1 | 6/2005 | Van Der Laan et al. |
| 2008/0220990 | A1 | 9/2008 | Fox |
| 2009/0312196 | A1 | 12/2009 | Colbeck et al. |

FOREIGN PATENT DOCUMENTS

| | | |
|---|---|---|
| WO | 2004/111241 A1 | 12/2004 |
| WO | 2007/138148 A1 | 12/2007 |

OTHER PUBLICATIONS

Gabor, E. M., et al., "A novel penicilline acylase from the environmental gene pool with improved synthetic properties," Enzyme and Microbial Technology, 36:182-190, 2005.
Wen, Y., et al., "Expression and overproduction of recombinant penicillin G acylase from Kluyvera citrophila in *Escherichia coli*," Enzyme and Microbial Technology, 37:233-237, 2005.
Alkema et al., "The use of chromogenic reference substrates for the kinetic analysis of penicillin acylases," *Anal. Biochem.* 275: 47-53 (1999).
Alkema et al., "Characterization of the beta-actum binding site of penicillin acylase of *Escherichia coli* by structural and site-directed mutagenesis studies," *Protein Eng.* 12:857-863 (2000).
Alkema et al., "Rode of αARG βArg in the active site of penicillin acylase of *Escherichia coli*," *Biochem J.* 365:303-309 (2002).
Alkema et al., "The role of hydrophobic active-site residues in substrate specificity and acyl transfer activity of penicillin acylase," *Eur. J. Biochem* 269:2093-2100 (2002).
Barbero et al., "Complete nucleotide sequence of the penicillin acylase gene from kluyvera citrophilia," *Gene* 49(1):69-80 (1986).
Done et al., "Ligand-induced Conformational Change in Penicillin Acylase," *J. Mol. Biol.* 284:463-475 (1998).
GENBANK accession No. P07941, [gi:129551], (Aug. 1998).
Flores et al., "Production of a fully functional, permuted single-chain penicillin G acylase," *Protein Science* 13:1677-1683 (2004).
Guncheva et al., "Kinetic studies and molecular modeling attribute a crucial role in the specificity and stereoselectivity of penicillin acylase to the pair ArgA145-ArgB263," *Eur J. Biochem.* 271:2272-2279 (2004).
Huang et al., *Macromol Biosci.*Jun. 11:8(6):508-15 (2008).
Jager et al., "Saturation mutagenesis reveals the importance of residues αR145 and αF146 of penicillin acylase in the synthesis of β-lactam antibiotics," *Journal of Biotechnology*, 133(1):18-26 (2008).
Kheirolomoom et al., "Influence of External Mass Transfer Limitation on Apparent Kinetic Parameters of Penicillin G Acylase Immobilized on Nonporous Ultrafine Silica Particles," *J. Biosci Biogeng.* 93:125-129 (2002).
Liu et al., "Preparation of optically pure tert-leucine by penicillin G acylase-catalyzed resolution," *Prep Biochem Biotechnol.* 36(3):235-41 (2006).
Martin et al., "Thermodynamic profiles of penicillin G hydrolysis catalyzed by wild-type and Met->Ala168 mutant penicillin acylases from *Kluyvera citrophila*," *Biochim Biophys Acta.* 1037(2):133-9 (1990).
Morillas et al., "Mutations of penicillin acylase residue B71 extend substrate specificity by decreasing steric contstraints for substrate binding," *Biochem. J.* 371:143-150 (2003).
Oh et al., "Modifying the substrate specificity of penicillin G acylase to cephalosporin acylase by mutating active-side residues," *Biochem. Biophys Res. Comm.* 319:486-492 (2004).
Polizzi et al., "Structure-guided consensus approach to create a more thermostable penicillin G acylase," *Biotechnol. J.* 1:531-536 (2006).
Prieto et al., "Penicillin acylase mutants with altered site-dirercted acitivity from Kluyvera citrophila," *Appl Microbiol Biotechnol.* 33(5):553-9 (1990).
Roa et al., "Changing the substrate specificity of penicillin G acylase from *Kluyvera citrophila* through selective pressure," *Biochem J.* 303:869-75 (1994).
Wang et al., "An efficient immobilizing technique of penicillin acylase with combining mesocellular silica foams support and p-benzoquinone cross linker," *Bioprocess Biosyst Eng.* 31:509-17 (2008).
Zhou et al., "Improving the specific synthetic activity of a penicillin G acylase using DNA family shuffling," *Sheng Wu Hua Xue Yu Sheng Wu Wu Li Xue Bao (Shanghai)* 35(6):573-9 (2003).

*Primary Examiner* — Rebecca Prouty
(74) *Attorney, Agent, or Firm* — Codexis, Inc.

(57) ABSTRACT

The present disclosure relates to engineered penicillin G acylase (PGA) enzymes having improved properties, polynucleotides encoding such enzymes, compositions including the enzymes, and methods of using the enzymes.

6 Claims, No Drawings

PENICILLIN-G ACYLASES

1. CROSS-REFERENCE TO RELATED APPLICATION

The present application claims priority of U.S. provisional application 61/113,224, filed Nov. 10, 2008, which is hereby incorporated by reference herein.

2. TECHNICAL FIELD

The present disclosure relates to engineered penicillin G acylase (PGA) enzymes, polynucleotides encoding the enzymes, compositions comprising the enzymes, and methods of using the engineered PGA enzymes.

3. REFERENCE TO SEQUENCE LISTING, TABLE OR COMPUTER PROGRAM

The Sequence Listing concurrently submitted herewith under 37 C.F.R. §1.821 in a computer readable form (CRF) via EFS-Web as file name CX2-028US1_ST25.txt is herein incorporated by reference. The electronic copy of the Sequence Listing was created on Nov. 6, 2009, with a file size of 872 Kbytes. This Sequence Listing is identical except for minor formatting corrections to 376247-026USP1.txt (880 Kbytes) created Nov. 10, 2008, which was incorporated by reference in the priority U.S. provisional application 61/113,224.

4. BACKGROUND

Penicillin G acylase (PGA) (penicillin amidase, EC 3.5.1.11) catalyzes the cleavage of the amide bond of penicillin G (benzylpenicillin) side chain. The enzyme is used commercially in the manufacture of 6-amino-penicillanic acid (6-APA) and phenyl-acetic acid (PAA). 6-APA is a key compound in the industrial production of semi-synthetic β-lactam antibiotics such as amoxicillin, ampicillin and cephalexin. The naturally occurring PGA enzyme shows instability in commercial processes, requiring immobilization on solid substrates for commercial applications. PGA has been covalently bonded to various supports and PGA immobilized systems have been reported as useful tools for the synthesis of pure optical isomers. Attachment to solid surfaces, however, leads to compromised enzyme properties, such as reduced activity and/or selectivity, and limitations to solute access. Moreover, although attachment to solid substrates allows capture of enzymes and reuse in additional processing cycles, the stability of the enzyme is such that such applications may be limited. The enzymatic catalysis by PGA of penicillin G to 6-APA is regiospecific (it does not cleave the lactam amide bond) and stereospecific. The production of 6-APA constitutes perhaps the largest utilization of enzymatic catalysis in the production of pharmaceuticals. The enzymatic activity of PGA, associated with the phenacetyl moiety, allows the stereospecific hydrolysis of a rich variety of phenacetyl derivatives of primary amines as well as alcohols.

Given the commercial use of PGA in the manufacture of various chemical intermediates, there is a need for improved forms of the enzyme.

5. SUMMARY

The present disclosure relates to engineered penicillin G acylase (PGA) polypeptides that are capable of mediating the conversion of penicillin G (i.e., benzylpenicillin) to phenylacetic acid and 6-aminopenicillanic acid (6-APA), polynucleotides encoding such polypeptides, and methods for using these polypeptides. The engineered PGA polypeptides of the disclosure have improved properties in mediating the cleavage reaction as compared to the naturally occurring PGA obtained from *Kluyvera citrophila*, the pre-pro form of which is provided as SEQ ID NO: 2. In some embodiments, model substrates, such as cleavage of 6-nitro-3-(phenylacetamide)benzoic acid (NIPAB) to phenylacetic acid and 5-amino-2-nitro-benzoic acid, can be used as a measure of PGA activity.

In some embodiments, the improved properties of the engineered PGA polypeptides of the present disclosure include: enzymatic activity, such as an increase in its rate of conversion of the substrate to the product; increases in stability (e.g., solvent stability) or thermostability; broadened substrate recognition (e.g., increase in diversity of substrate structures recognized), and enzyme stereospecificity. In some embodiments, the engineered PGA can have more than one improved property, such as increased improved enzymatic activity and increased stability.

In some embodiments, the engineered PGA can comprise an α-chain sequence and a β-chain sequence, which can be present as separate polypeptides in the mature enzyme, or be present as part of a single chain polypeptide. When present as a single chain form, the engineered PGA polypeptide can comprise, from the amino to carboxy terminus, the structure

B-L-A wherein B is the β-chain sequence (or B unit); A is the α-chain sequence (or A unit); and L is a linker connecting the β-chain to the α-chain sequences. In some embodiments, the B unit corresponds to the sequence of SEQ ID NO: 180 and the A unit comprises the sequence of SEQ ID NO: 179. In some embodiments, the spacer or linker L comprises a spacer or linker of sufficient length and flexibility to permit proper folding and interaction of the A and B units to form a functional PGA enzyme. An exemplary linker/space comprises the amino acid sequence Gln~Leu~Asp~Gln.

Whether in the form of separate polypeptides or as a single chain polypeptide, the α- and β-chain sequences can have one or more residue differences as compared to the naturally occurring α- and β-chain sequences of *K. citrophila* PGA, corresponding to SEQ ID NOs: 179 and 180, respectively. In some embodiments, the engineered PGA can comprise an α- (A unit) and a β-chain (B unit), wherein the α-chain sequence comprises an amino acid sequence having at least 85%, 86%, 87%, 88%, 89%, 90%, 91%, 92%, 93%, 94%, 95%, 96%, 97%, 98%, 99% or more identity to SEQ ID NO:179, and the β-chain sequence comprises an amino acid sequence having at least 85%, 86%, 87%, 88%, 89%, 90%, 91%, 92%, 93%, 94%, 95%, 96%, 97%, 98%, 99% or more identity to SEQ ID NO:180, where the engineered PGA enzyme has an improved property as compared to the naturally occurring PGA of *K. citrophila*. The sequence of SEQ ID NO: 179 corresponds to residues 27 to 235 of the pre-pro-PGA sequence of SEQ ID NO: 2, and represents the α-chain sequence of the naturally occurring PGA of *K. citrophila*. The sequence of SEQ ID NO: 180 corresponds to residues 290 to 844 of the pre-pro-PGA sequence of SEQ ID NO: 2, and represents the β-chain sequence of the naturally occurring PGA of *K. citrophila*. In some embodiments, the α- and/or β-chain sequences of the engineered PGA can have one or more residue differences as compared to the naturally occurring α- and β-chain sequences of *K. citrophila* that result in an improved property of the PGA.

In some embodiments, an engineered PGA capable of cleaving the substrate penicillin G or NIPAB to the corresponding products, can comprise an A unit and a B unit, wherein the A-unit comprises an amino acid sequence having at least 85%, 86%, 87%, 88%, 89%, 90%, 91%, 92%, 93%, 94%, 95%, 96%, 97%, 98%, 99% or more identity to residues 560 to 764 of the engineered PGA of SEQ ID NO: 130 and the B-unit comprises an amino acid sequence having at least 85%, 86%, 87%, 88%, 89%, 90%, 91%, 92%, 93%, 94%, 95%, 96%, 97%, 98%, 99% or more identity to residues 1 to 555 of the engineered PGA of SEQ ID NO: 130. In some embodiments, the α and/or β chain sequences of the engineered PGA can have one or more residue differences as compared to the A unit and/or B unit of the engineered PGA of SEQ ID NO: 130.

Various residue differences that can be present in the α and/or β chain sequences are described in the detailed disclosure. In some embodiments, the engineered PGA polypeptides can be based on sequence formula of SEQ ID NO: 181, which sequence formula describes features at various residue positions to generate the engineered PGA polypeptides of the disclosure.

In some embodiments, where the engineered PGA is a single chain polypeptide, the linker or spacer linking the α and β chains can be a peptide of sufficient length and flexibility to allow the β and α units to interact and form a functional PGA. In some embodiments, the spacer or linker peptides are 2, 3, 4, 5, 6, 7, 8, 9, 10, 11, 12, 13, 14, 15, 16, 18 or 20 or more amino acids in length. In particular, the spacer or linker length is about 4, 5 or 6 amino acids in length. In some embodiments, the linker or spacer comprises a peptide of small amino acids, such as glycine, alanine, serine, or threonine. In some embodiments, the linker or spacer can comprise a peptide of the following structure:

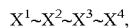

wherein
X¹ is a basic, acidic, polar, non-polar, aliphatic, or constrained residue;
X² is a constrained, acidic, non-polar or aliphatic residue;
X³ is a basic, acidic, polar, non-polar, aliphatic residue; and
X⁴ is a basic, acidic, polar, non-polar, aliphatic residue.

In some embodiments, the linker or spacer comprises a peptide in which X¹ is a polar residue; X² is a non-polar or aliphatic residue; X³ is an acidic residue; and X⁴ is a polar residue. In some embodiments, the linker or spacer has the following structure: Gln-Leu-Asp-Gln.

In some embodiments, the engineered PGA enzymes can have improvement in enzymatic activity of at least 1.5 times the enzymatic activity of the corresponding wild-type PGA enzyme of K. citrophila, to as much as at least 2 times, at least 2.5 times, 3 times, 4 times, 5 times, 10 times, 20 times, 25 times or more of the enzyme activity of the naturally occurring PGA of K. citrophila. In some embodiments, the improvement in enzymatic activity is with respect to cleavage of NIPAB to the corresponding 5-amino-3-nitrobenzoic acid and phenylacetic acid.

In some embodiments, the engineered PGA enzyme with improved enzymatic activity comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, and 178.

In some embodiments, the engineered PGA polypeptides are capable of mediating conversion of 6-nitro-3-(phenylacetamide)benzoic acid to phenylacetic acid and 5-amino-2-nitro-benzoic acid at a rate that is at least 1.5 times greater than the naturally occurring PGA of K. citrophila (e.g., the mature PGA enzyme based on SEQ ID NO:2), and comprise α- and β-chain amino acid sequences having at least 85%, 86%, 87%, 88%, 89%, 90%, 91%, 92%, 93%, 94%, 95%, 96%, 97%, 98%, 99% or more identity to the reference α- and β-chain sequences of any one of SEQ ID NO: 4, 6, 8, 20, 24, 26, 30, 32, 46, 48, 52, 54, 56, 58, 60, 62, 64, 72, 82, 84, 86, 88, 90, 96, 98, 100, 148, and 172.

In some embodiments, the engineered PGA polypeptides have changed substrate recognition by displaying activity against substitute phenyl acetate esters and amides. In some embodiments, the engineered PGA polypeptides are capable of converting greater than 15% of methyl 4-methoxyphenylacetate ester to the corresponding product, wherein the PGA polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 6, 16, 22, 24, 46, 52, 54, 60, 62, 64, 144, 146, 148, 150, 162, 166, 168, 170, 172, 176, and 178.

In some embodiments, the engineered PGA polypeptides are capable of converting greater than 30% of methyl 4-hydroxy phenylacetate ester to the corresponding products, wherein the polypeptide comprises a sequence having at least 85%, 86%, 87%, 88%, 89%, 90%, 91%, 92%, 93%, 94%, 95%, 96%, 97%, 98%, 99% or more identity to a sequence selected from SEQ ID NO: 6, 8, 10, 16, 20, 22, 24, 30, 34, 36, 38, 40, 42, 44, 48, 50, 52, 54, 56, 58, 60, 62, 64, 78, 80, 82, 84, 86, 88, 90, 92, 98, 100, 132, 134, 136, 142, 144, 146, 148, 150, 154, 162, 166, 168, 170, 172, 176, and 178.

In some embodiments, the engineered PGA polypeptides are capable of converting greater than 20% of methyl 4-chloro phenylacetate ester to the corresponding products, wherein the polypeptide comprises a sequence having at least 85%, 86%, 87%, 88%, 89%, 90%, 91%, 92%, 93%, 94%, 95%, 96%, 97%, 98%, 99% or more identity to a sequence selected from SEQ ID NO: 8, 16, 20, 22, 24, 30, 32, 34, 36, 46, 52, 54, 74, 76, 78, 88, 90, 92, 96, 98, 126, 128, 130, 132, 134, 136, 142, 144, 146, 148, 150, 162, 168, 170, 172, 176, and 178.

In some embodiments, the engineered PGA polypeptides are capable of converting greater than 10% of methyl phenylacetate ester to the corresponding products, wherein the polypeptide comprises a sequence having at least 85%, 86%, 87%, 88%, 89%, 90%, 91%, 92%, 93%, 94%, 95%, 96%, 97%, 98%, 99% or more identity to a sequence selected from SEQ ID NO: 4, 6, 8, 10, 12, 16, 20, 22, 24, 30, 32, 34, 36, 38, 40, 42, 44, 46, 48, 52, 54, 56, 58, 60, 62, 64, 68, 70, 72, 74, 76, 78, 80, 88, 92, 94, 96, 98, 100, 102, 104, 106, 108, 110, 112, 114, 116, 118, 120, 122, 124, 126, 128, 130, 132, 138, 140, 142, 144, 146, 148, 150, 152, 156, 160, 162, 164, 166, 168, 170, 172, 176, and 178.

In some embodiments, the engineered PGA polypeptides are capable of converting methyl α-methyl-4-chlorophenylacetate ester at a rate greater than the naturally occurring PGA of K. citrophila, wherein the polypeptide comprises a sequence having at least 85%, 86%, 87%, 88%, 89%, 90%, 91%, 92%, 93%, 94%, 95%, 96%, 97%, 98%, 99% or more identity to a sequence selected from SEQ ID NO: 4, 6, 16, 20, 22, 24, 30, 32, 34, 52, 54, 60, 66, 68, 70, 74, 76, 78, 84, 86, 128, 130, 132, 134, 136, 146, 148, 150, 162, 166, 168, 170, 172, and 178.

In some embodiments, the engineered PGA polypeptides are capable of converting 15% or more of methyl α-hydroxy phenylacetate ester to the corresponding products, wherein the polypeptide comprises a sequence having at least 85%, 86%, 87%, 88%, 89%, 90%, 91%, 92%, 93%, 94%, 95%, 96%, 97%, 98%, 99% or more identity to a sequence selected from SEQ ID NO: 4, 6, 10, 16, 18, 20, 22, 24, 30, 32, 34, 36, 38, 40, 42, 44, 48, 50, 54, 56, 58, 60, 62, 64, 72, 74, 76, 78, 80, 82, 84, 86, 88, 92, 96, 98, 100, 102, 132, 142, 144, 146, 150, 156, 158, 160, 162, 164, 166, 168, 170, 172, 174, 176, and 178.

In some embodiments, the engineered PGA polypeptides are capable of converting methyl α-methoxy phenylacetate ester to the corresponding products at a rate greater than the naturally occurring PGA of *K. citrophila*, wherein the polypeptide comprises a sequence having at least 85%, 86%, 87%, 88%, 89%, 90%, 91%, 92%, 93%, 94%, 95%, 96%, 97%, 98%, 99% or more identity to a sequence selected from SEQ ID NO: 12, 32, 40, 42, 54, 56, 58, 62, 64, 68, 78, 80, 152, 156, and 160.

In some embodiments, the engineered PGA polypeptides are capable of converting 20% or more of 1-phenylethyl 2-phenylacetate to the corresponding products, wherein the polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 4, 8, 10, 16, 20, 22, 24, 32, 34, 38, 40, 42, 44, 46, 48, 50, 52, 54, 56, 58, 60, 62, 64, 70, 72, 74, 82, 84, 86, and 88.

In some embodiments, the engineered PGA polypeptides are capable of converting 10% or more of 1-phenylpropyl 2-phenylacetate to the corresponding products, wherein the polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 4, 8, 10, 20, 22, 24, 30, 32, 34, 38, 40, 42, 44, 46, 48, 50, 52, 54, 56, 58, 60, 62, 64, 82, 84, 86, 88, 152, and 156.

In some embodiments, the engineered PGA polypeptides have stereospecificity for R 1-phenylethyl 2-(4-chloro-phenyl)acetate, and is capable of forming an enantiomeric excess of 20% or more of R 1-phenylethanol, wherein the polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 0.4, 6, 8, 10, 12, 14, 20, 22, 24, 26, 28, 30, 32, 34, 36, 38, 44, 46, 48, 50, 52, 54, 56, 58, 60, 62, 64, 68, 70, 72, 74, 76, 82, 84, 86, and 88.

In some embodiments, the engineered PGA polypeptides of the disclosure can be stereospecific to the acyl acceptor or acyl donor portion of the PGA substrates. In some embodiments, the engineered PGA polypeptides have S stereospecificity for methyl α-hydroxy phenylacetate ester and are capable of forming an enantiomeric excess of 10% or more of S α-hydroxy phenylacetic acid, wherein the PGA polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 4, 10, 16, 30, 32, 84, 86, 88, 92, 96, 98, 100, 134, 136, 142, 144, 146, 148, 150, 154, 162, 164, 166, 168, 170, 172, 174, and 176.

In some embodiments, the engineered PGA polypeptides have R stereospecificity for methyl α-hydroxy phenylacetate ester, and are capable of forming an enantiomeric excess of R-α-hydroxy phenylacetic acid, wherein the polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 6, 8, 12, 14, 18, 20, 22, 34, 36, 38, 40, 42, 44, 48, 50, 52, 54, 56, 58, 60, 62, 64, 66, 68, 70, 72, 74, 76, 78, 80, 94, 102, 106, 152, 156, 158, and 160.

In some embodiments, the engineered PGA polypeptides have S stereospecificity for methyl α-methoxy phenylacetate ester, and are capable forming an enantiomeric excess of S-α-methoxy phenylacetic acid, wherein the polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 12, 32, 40, 54, 56, 58, 62, 64, 152, 156, and 160.

In some embodiments, the engineered PGA polypeptides have R stereospecificity for R-1-phenylethyl 2-phenylacetate, and is capable of forming an enantiomeric excess of 20% or more of R-phenylethanol, wherein the polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 4, 6, 8, 10, 12, 14, 20, 22, 24, 26, 28, 30, 32, 34, 36, 38, 40, 42, 44, 46, 48, 50, 52, 54, 56, 58, 60, 62, 64, 66, 68, 70, 72, 74, 76, 80, 82, 84, 86, 88, 94 and 160.

In some embodiments, the engineered PGA polypeptides have stereospecificity for R-1-phenylethyl 2-phenylacetate, and is capable of forming an enantiomeric excess of greater than 50% of R-1-phenylethanol, wherein the polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 4, 8, 10, 12, 14, 20, 26, 28, 30, 32, 34, 36, 38, 40, 42, 44, 46, 48, 50, 52, 54, 56, 58, 60, 62, 64, 66, 76, 84, 86, 88, 94, and 160.

In some embodiments, the engineered PGA polypeptides have stereospecificity for R 1-phenylpropyl 2-phenylacetate, and is capable of forming an enantiomeric excess of greater than 10% of R-1-phenylpropanol, wherein the polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 10, 32, 34, 40, 42, 48, 50, 52, 54, 56, 60, 62, 64, and 84.

In some embodiments, the engineered PGA polypeptides have a synthesis/hydrolysis (S/H) ratio that is improved over the naturally occurring PGA of *K. citrophila*, wherein the polypeptide comprises an amino acid sequence having at least 85%, 86%, 87%, 88%, 89%, 90%, 91%, 92%, 93%, 94%, 95%, 96%, 97%, 98%, 99% or more identity to a sequence selected from SEQ ID NO: 22, 24, 26, 82, and 84.

In some embodiments, the engineered PGA enzymes can be used in a method for mediating the cleavage of penicillin G substrate to phenylacetic acid and 6-aminopenicillanic acid products (see Scheme 1):

Scheme 1

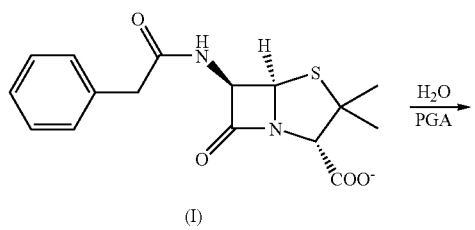

(I)

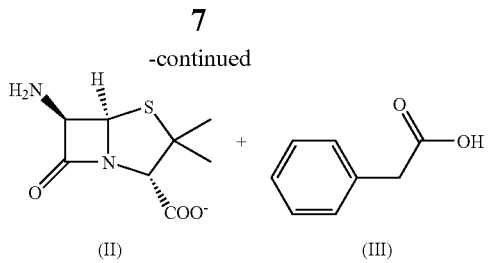

(II) + (III)

In these methods, the penicillin G is contacted with an engineered PGA enzyme of the disclosure under suitable reaction conditions to produce the products phenylacetic acid and 6-aminopenicillanic acid. As noted above, the engineered PGA enzymes can be a heterodimer formed from separate α- and β-chains or be present as a single chain PGA enzyme (e.g., based on SEQ ID NO: 32).

In some embodiments of the method, the engineered PGA enzymes used in the method can comprise an α-chain sequence and/or a β-chain sequence corresponding to a reference α-chain sequence (i.e., sequence corresponding to positions 560-764) and/or reference β-chain sequence (i.e., sequence corresponding to positions 1-555) of any one of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, and 178.

In some embodiments, the engineered PGA enzymes used in the method can comprise the single chain PGA enzyme comprising an amino acid sequence the sequence of any one of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, and 178; or a sequence having at least 85%, 86%, 87%, 88%, 89%, 90%, 91%, 92%, 93%, 94%, 95%, 96%, 97%, 98%, 99% or more identity to any one of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, and 178.

In some embodiments, the disclosure provides a composition comprising: (i) a penicillin G of structural formula (I), a 6-amino penicillanic acid of structural formula (II), and/or a phenylacetic acid of structural formula (III); and (ii) an engineered PGA polypeptide selected comprising an amino acid sequence selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178

In some embodiments, the engineered PGA enzymes of the disclosure can be used in a method for the synthesis of β-lactam antibiotics. In some embodiments, the PGA enzymes can be used in a method for the synthesis of ampicillin or cephalexin, where the method comprises contacting the compound of structural formula (II) or (XVII), and the compound of structural formula (XVIII), with an engineered PGA polypeptide of the disclosure, under suitable reaction conditions for the production of ampicillin or cephalexin, respectively (see Scheme 7).

Scheme 7

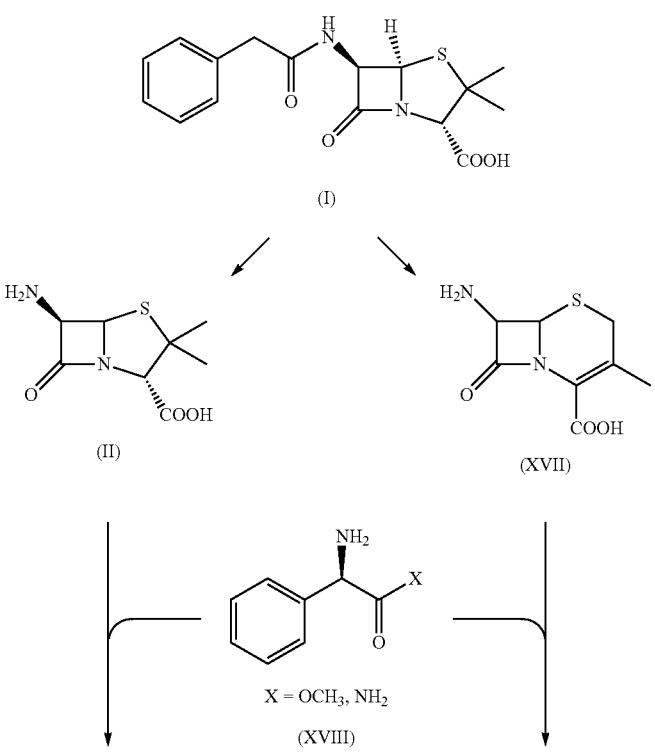

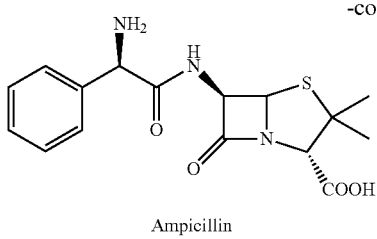
Ampicillin

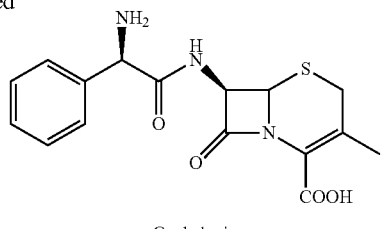
Cephalexin

In some embodiments of the method for synthesis of β-lactam antibiotics, the engineered PGA enzymes for use in the method can comprise an amino acid sequence corresponding to the sequence of SEQ NO: 22, 24, 26, 82, or 84.

The present disclosure also provides an improved method for the synthesis of a β-lactam antibiotic, wherein the improvement comprises a step of contacting an engineered PGA enzyme of the present disclosure with a substrate, wherein the substrate comprises a β-lactam antibiotic precursor compound, under suitable reaction conditions for the production of the β-lactam antibiotic. Accordingly, in some embodiments the present disclosure provides a method for the synthesis of ampicillin or cephalexin, wherein the method comprises a step of contacting a compound of structural formula (II) or (XVII), and a compound of structural formula (XVIII), with an engineered PGA polypeptide of the disclosure, under suitable reaction conditions for the production of ampicillin or cephalexin, respectively.

Further, in some embodiments, the present disclosure provides a composition comprising an engineered PGA polypeptide of the disclosure (e.g., a polypeptide of SEQ ID NO: 22, 24, 26, 82, or 84) and a compound of structural formulas (II), (XVII), and/or (XVIII).

6. DETAILED DESCRIPTION

The present disclosure provides engineered penicillin G acylases (PGA) that are capable of cleaving penicillin to phenylacetic acid and 6-aminopenicillanic acid (6-APA), which is a key intermediate in the synthesis of a large variety of β-lactam antibiotics. Generally, naturally occurring PGAs are a heterodimeric enzyme composed of a α-subunit and β-subunit. Wild-type PGA is naturally synthesized as a pre-pro-PGA polypeptide, containing an N-terminal signal peptide that mediates translocation to the periplasm and a linker region connecting the C-terminus of the α-subunit to the N-terminus of the β-subunit. Proteolytic processing leads to the mature heterodimeric enzyme. The intermolecular linker region can also function in promoting proper folding of the enzyme. The PGAs in the present disclosure are based on the PGA from *Kluyvera citrophila* in which various modifications have been introduced to generate improved enzymatic properties as described in detail below.

For the descriptions provided herein, the use of the singular includes the plural (and vice versa) unless specifically stated otherwise. For instance, the singular forms "a", "an" and "the" include plural referents unless the context clearly indicates otherwise. Similarly, "comprise," "comprises," "comprising" "include," "includes," and "including" are interchangeable and not intended to be limiting. It is to be further understood that where descriptions of various embodiments use the term "comprising," those skilled in the art would understand that in some specific instances, an embodiment can be alternatively described using language "consisting essentially of" or "consisting of."

Both the foregoing general description, including the drawings, and the following detailed description are exemplary and explanatory only and are not restrictive of this disclosure. Moreover, the section headings used herein are for organizational purposes only and not to be construed as limiting the subject matter described.

6.1. Definitions

As used herein, the following terms are intended to have the following meanings.

"Acylase" or "acyltransferases" are used interchangeably herein to refer to enzymes that are capable of transferring an acyl group from a donor to an acceptor to form esters or amides. The acylase mediated reverse reaction results in hydrolysis of the ester or amide.

"Penicillin G acylase" and "PGA" are used interchangeably herein to refer to an enzyme having the capability of mediating cleavage of penicillin G (benzylpenicillin) to phenylacetic acid (PHA) and 6-aminopenicillanic acid (6-APA). In some embodiments, PGA activity can be based on cleavage of model substrates, for instance the cleavage of 6-nitro-3-(phenylacetamide)benzoic acid to phenylacetic acid and 5-amino-2-nitro-benzoic acid. PGAs are also capable of carrying out the reverse reaction of transferring an acyl group of an acyl donor to an acyl acceptor. PGAs as used herein include naturally occurring (wild type) PGAs as well as non-naturally occurring PGA enzymes comprising one or more engineered polypeptides generated by human manipulation.

"Acyl donor" refers to that portion of the acylase substrate which donates the acyl group to an acyl acceptor to form esters or amides.

"Acyl acceptor" refers to that portion of the acylase substrate which accepts the acyl group of the acyl donor to form esters or amides.

"α-chain sequence" as used herein refers to an amino acid sequence that corresponds to (e.g., has at least 85% identity to) the residues at positions 27 to 235 of SEQ ID NO: 2 or positions 560-764 of SEQ ID NO: 32. As used herein, a single chain polypeptide can comprise an "α-chain sequence" and additional sequence(s) (e.g., a "β-chain" sequence as in SEQ ID NO:32).

"β-chain sequence" as used herein refers to an amino acid sequence that corresponds to (e.g., has at least 85% identity to) residues at positions 290 to 846 of SEQ ID NO:2 or positions 1-555 of SEQ ID NO: 32. As used herein, a single chain polypeptide can comprise an "β-chain sequence" and additional sequence(s) (e.g., a "α-chain" sequence as in SEQ ID NO:32).

"Coding sequence" refers to that portion of a nucleic acid (e.g., a gene) that encodes an amino acid sequence of a protein.

"Naturally-occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

"Recombinant" or "engineered" or "non-naturally occurring" when used with reference to, e.g., a cell, nucleic acid, or polypeptide, refers to a material, or a material corresponding to the natural or native form of the material, that has been modified in a manner that would not otherwise exist in nature, or is identical thereto but produced or derived from synthetic materials and/or by manipulation using recombinant techniques (e.g., genetic engineering). Non-limiting examples include, among others, recombinant cells expressing genes that are not found within the native (non-recombinant) form of the cell or express native genes that are otherwise expressed at a different level.

"Percentage of sequence identity" or "percent identity" or "percent identical" are used herein to refer to comparisons between polynucleotide sequences or polypeptide sequences, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage is calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Determination of optimal alignment and percent sequence identity is performed using the BLAST and BLAST 2.0 algorithms (see e.g., Altschul et al., 1990, J. Mol. Biol. 215: 403-410 and Altschul et al., 1977, Nucleic Acids Res. 3389-3402). Software for performing BLAST analyses is publicly available through the National Center for Biotechnology Information website.

Briefly, the BLAST analyses involve first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff, 1989, Proc Natl Acad Sci USA 89:10915).

Numerous other algorithms are available that function similarly to BLAST in providing percent identity for two sequences. Optimal alignment of sequences for comparison can be conducted, e.g., by the local homology algorithm of Smith and Waterman, 1981, Adv. Appl. Math. 2:482, by the homology alignment algorithm of Needleman and Wunsch, 1970, J. Mol. Biol. 48:443, by the search for similarity method of Pearson and Lipman, 1988, Proc. Natl. Acad. Sci. USA 85:2444, by computerized implementations of these algorithms (GAP, BESTFIT, FASTA, and TFASTA in the GCG Wisconsin Software Package), or by visual inspection (see generally, Current Protocols in Molecular Biology, F. M. Ausubel et al., eds., Current Protocols, a joint venture between Greene Publishing Associates, Inc. and John Wiley & Sons, Inc., (1995 Supplement) (Ausubel)). Additionally, determination of sequence alignment and percent sequence identity can employ the BESTFIT or GAP programs in the GCG Wisconsin Software package (Accelrys, Madison Wis.), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides over a "comparison window" to identify and compare local regions of sequence similarity.

In some embodiments, a "reference sequence" can be based on a primary amino acid sequence, where the reference sequence is a sequence that can have one or more changes in the primary sequence. For instance, a "reference sequence based on SEQ ID NO: 32 having at the residue corresponding to X547 is a glutamine" refers to a reference sequence in which the corresponding residue at X547 in SEQ ID NO: 32 has been changed to a glutamine.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Substantial identity" refers to a polynucleotide or polypeptide sequence that has at least 80 percent sequence identity, at least 85 percent identity and 89 to 95 percent sequence identity, more usually at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). Preferably, residue positions which are not identical differ by conservative amino acid substitutions.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered PGA, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Enantiomeric excess and diastereomeric excess are types of stereomeric excess.

"Highly stereoselective" refers to a PGA that is capable of converting or reducing the substrate to the corresponding product having the chemical formula (II) or (III) with at least about 85% stereomeric excess.

"Stereospecificity" refers to the preferential conversion in a chemical or enzymatic reaction of one stereoisomer over another. Stereospecificity can be partial, where the conversion of one stereoisomer is favored over the other, or it may be complete where only one stereoisomer is converted.

"Chemoselectivity" refers to the preferential formation in a chemical or enzymatic reaction of one product over another.

"Improved enzyme property" refers to a PGA that exhibits an improvement in any enzyme property as compared to a reference PGA. For the engineered PGA polypeptides described herein, the comparison is generally made to the wild-type PGA enzyme, although in some embodiments, the reference PGA can be another improved engineered PGA. Enzyme properties for which improvement is desirable include, but are not limited to, enzymatic activity (which can be expressed in terms of percent conversion of the substrate at a specified reaction time using a specified amount of PGA), thermal stability, solvent stability, pH activity profile, cofactor requirements, refractoriness to inhibitors (e.g., product inhibition), stereospecificity, and stereoselectivity (including enantioselectivity).

"Increased enzymatic activity" refers to an improved property of the engineered PGA polypeptides, which can be represented by an increase in specific activity (e.g., product produced/time/weight protein) or an increase in percent conversion of the substrate to the product (e.g., percent conversion of starting amount of substrate to product in a specified time period using a specified amount of PGA) as compared to the reference PGA enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.5 times the enzymatic activity of the corresponding wild-type PGA enzyme, to as much as 2 times. 5 times, 10 times, 20 times, 25 times, 50 times, 75 times, 100 times, or more enzymatic activity than the naturally occurring PGA or another engineered PGA from which the PGA polypeptides were derived. In specific embodiments, the engineered PGA enzyme exhibits improved enzymatic activity in the range of 1.5 to 50 times, 1.5 to 100 times greater than that of the parent PGA enzyme. It is understood by the skilled artisan that the activity of any enzyme is diffusion limited such that the catalytic turnover rate cannot exceed the diffusion rate of the substrate, including any required cofactors. The theoretical maximum of the diffusion limit, or $k_{cat}/K_m$, is generally about $10^8$ to $10^9$ ($M^{-1}$ $s^{-1}$). Hence, any improvements in the enzyme activity of the PGA will have an upper limit related to the diffusion rate of the substrates acted on by the PGA enzyme. PGA activity can be measured by any one of standard assays used for measuring the release of phenylacetic acid upon cleavage of penicillin G, such as by titration (see, e.g., Simons, H. and Gibson, T. D., 1999, *Biotechnology Techniques* 13, 365-367). In some embodiments, the PGA activity can be measured by using 6-nitrophenylacetamido benzoic acid (NIPAB), which cleavage product 5-amino-2-nitro-benzoic acid is detectable spectrophotometrically (λmax=405 nm). Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

"Conversion" refers to the enzymatic reduction of the substrate to the corresponding product. "Percent conversion" refers to the percent of the substrate that is reduced to the product within a period of time under specified conditions. Thus, the "enzymatic activity" or "activity" of a PGA polypeptide can be expressed as "percent conversion" of the substrate to the product.

"Thermostable" refers to a PGA polypeptide that maintains similar activity (more than 60% to 80% for example) after exposure to elevated temperatures (e.g., 40-80° C.) for a period of time (e.g., 0.5-24 hrs) compared to the untreated enzyme.

"Solvent stable" refers to a PGA polypeptide that maintains similar activity (more than e.g., 60% to 80%) after exposure to varying concentrations (e.g., 5-99%) of solvent (isopropyl alcohol, methanol, tetrahydrofuran, 2-methyltetrahydrofuran, acetone, toluene, butylacetate, methyl tert-butylether, acetonitrile, etc.) for a period of time (e.g., 0.5-24 hrs) compared to the untreated enzyme.

"pH stable" refers to a PGA polypeptide that maintains similar activity (more than e.g., 60% to 80%) after exposure to high or low pH (e.g., 4.5-6 or 8 to 12) for a period of time (e.g., 0.5-24 hrs) compared to the untreated enzyme.

"Thermo- and solvent stable" refers to a PGA polypeptide that is both thermostable and solvent stable.

"Derived from" as used herein in the context of engineered PGA enzymes, identifies the originating PGA enzyme, and/or the gene encoding such PGA enzyme, upon which the engineering was based. For example, the engineered PGA enzyme of SEQ ID NO: 60 was obtained by artificially evolving, over multiple generations the gene encoding the K. citrophila PGA α chain and β-chain sequences of SEQ ID NO:2. Thus, this engineered PGA enzyme is "derived from" the naturally occurring or wild-type PGA of SEQ ID NO: 2.

"Hydrophilic amino acid or residue" refers to an amino acid or residue having a side chain exhibiting a hydrophobicity of less than zero according to the normalized consensus hydrophobicity scale of Eisenberg et al., 1984, *J. Mol. Biol.* 179:125-142. Genetically encoded hydrophilic amino acids include L-Thr (T), L-Ser (S), L-His (H), L-Glu (E), L-Asn (N), L-Gln (O), L-Asp (D), L-Lys (K) and L-Arg (R).

"Acidic amino acid or residue" refers to a hydrophilic amino acid or residue having a side chain exhibiting a pK value of less than about 6 when the amino acid is included in a peptide or polypeptide. Acidic amino acids typically have negatively charged side chains at physiological pH due to loss of a hydrogen ion. Genetically encoded acidic amino acids include L-Glu (E) and L-Asp (D).

"Basic amino acid or residue" refers to a hydrophilic amino acid or residue having a side chain exhibiting a pK value of greater than about 6 when the amino acid is included in a peptide or polypeptide. Basic amino acids typically have positively charged side chains at physiological pH due to association with hydronium ion. Genetically encoded basic amino acids include L-Arg (R) and L-Lys (K).

"Polar amino acid or residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include L-Asn (N), L-Gln (O), L-Ser (S) and L-Thr (T).

"Hydrophobic amino acid or residue" refers to an amino acid or residue having a side chain exhibiting a hydrophobicity of greater than zero according to the normalized consensus hydrophobicity scale of Eisenberg et al., 1984, *J. Mol. Biol.* 179:125-142. Genetically encoded hydrophobic amino acids include L-Pro (P), L-Ile (I), L-Phe (F), L-Val (V), L-Leu (L), L-Trp (W), L-Met (M), L-Ala (A) and L-Tyr (Y).

"Aromatic amino acid or residue" refers to a hydrophilic or hydrophobic amino acid or residue having a side chain that includes at least one aromatic or heteroaromatic ring. Genetically encoded aromatic amino acids include L-Phe (F), L-Tyr (Y) and L-Trp (W). Although owing to the pKa of its heteroaromatic nitrogen atom L-His (H) it is sometimes classified as a basic residue, or as an aromatic residue as its side chain includes a heteroaromatic ring, herein histidine is classified as a hydrophilic residue or as a "constrained residue" (see below).

"Constrained amino acid or residue" refers to an amino acid or residue that has a constrained geometry. Herein, constrained residues include L-Pro (P) and L-His (H). Histidine has a constrained geometry because it has a relatively small imidazole ring. Proline has a constrained geometry because it also has a five membered ring.

"Non-polar amino acid or residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include L-Gly (G), L-Leu (L), L-Val (V), L-Ile (I), L-Met (M) and L-Ala (A).

"Aliphatic amino acid or residue" refers to a hydrophobic amino acid or residue having an aliphatic hydrocarbon side chain. Genetically encoded aliphatic amino acids include L-Ala (A), L-Val (V), L-Leu (L) and L-Ile (I).

"Cysteine" or L-Cys (C) is unusual in that it can form disulfide bridges with other L-Cys (C) amino acids or other sulfanyl- or sulfhydryl-containing amino acids. The "cysteine-like residues" include cysteine and other amino acids that contain sulfhydryl moieties that are available for formation of disulfide bridges. The ability of L-Cys (C) (and other amino acids with —SH containing side chains) to exist in a peptide in either the reduced free —SH or oxidized disulfide-bridged form affects whether L-Cys (C) contributes net hydrophobic or hydrophilic character to a peptide. While L-Cys (C) exhibits a hydrophobicity of 0.29 according to the normalized consensus scale of Eisenberg (Eisenberg et al., 1984, supra), it is to be understood that for purposes of the present disclosure L-Cys (C) is categorized into its own unique group.

"Small amino acid or residue" refers to an amino acid or residue having a side chain that is composed of a total three or fewer carbon and/or heteroatoms (excluding the α-carbon and hydrogens). The small amino acids or residues may be further categorized as aliphatic, non-polar, polar or acidic small amino acids or residues, in accordance with the above definitions. Genetically-encoded small amino acids include L-Ala (A), L-Val (V), L-Cys (C), L-Asn (N), L-Ser (S), L-Thr (T) and L-Asp (D).

"Hydroxyl-containing amino acid or residue" refers to an amino acid containing a hydroxyl (—OH) moiety. Genetically-encoded hydroxyl-containing amino acids include L-Ser (S) L-Thr (T) and L-Tyr (Y).

"Conservative" amino acid substitutions or mutations refer to the interchangeability of residues having similar side chains, and thus typically involves substitution of the amino acid in the polypeptide with amino acids within the same or similar defined class of amino acids. However, as used herein, in some embodiments, conservative mutations do not include substitutions from a hydrophilic to hydrophilic, hydrophobic to hydrophobic, hydroxyl-containing to hydroxyl-containing, or small to small residue, if the conservative mutation can instead be a substitution from an aliphatic to an aliphatic, non-polar to non-polar, polar to polar, acidic to acidic, basic to basic, aromatic to aromatic, or constrained to constrained residue. Further, as used herein, A, V, L, or I can be conservatively mutated to either another aliphatic residue or to another non-polar residue. The table below shows exemplary conservative substitutions.

TABLE 1

| Residue | Possible Conservative Mutations |
|---|---|
| A, L, V, I | Other aliphatic (A, L, V, I) |
| | Other non-polar (A, L, V, I, G, M) |
| G, M | Other non-polar (A, L, V, I, G, M) |
| D, E | Other acidic (D, E) |
| K, R | Other basic (K, R) |
| P, H | Other constrained (P, H) |
| N, Q, S, T | Other polar |
| Y, W, F | Other aromatic (Y, W, F) |
| C | None |

"Non-conservative substitution" refers to substitution or mutation of an amino acid in the polypeptide with an amino acid with significantly differing side chain properties. Non-conservative substitutions may use amino acids between, rather than within, the defined groups listed above. In one embodiment, a non-conservative mutation affects (a) the structure of the peptide backbone in the area of the substitution (e.g., proline for glycine) (b) the charge or hydrophobicity, or (c) the bulk of the side chain.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, up to 20% of the total number of amino acids, or up to 30% of the total number of amino acids making up the polypeptide while retaining enzymatic activity and/or retaining the improved properties of an engineered PGA enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. In some embodiments, the improved engineered PGA enzymes comprise insertions of one or more amino acids to the naturally occurring PGA polypeptide as well as insertions of one or more amino acids to other improved PGA polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

"Fragment" as used herein refers to a polypeptide that has an amino-terminal and/or carboxy-terminal deletion, but where the remaining amino acid sequence is identical to the corresponding positions in the sequence. Fragments can be at least 14 amino acids long, at least 20 amino acids long, at least 50 amino acids long or longer, and up to 70%, 80%, 90%, 95%, 98%, and 99% of the full-length PGA polypeptide, for example the polypeptide of SEQ ID NO:2, 4 or 86.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The improved PGA enzymes may be present within a cell, present in the cellular medium, or prepared in various forms, such as lysates or isolated preparations. As such, in some embodiments, the improved PGA enzyme can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure PGA composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated improved PGAs polypeptide is a substantially pure polypeptide composition.

"Stringent hybridization" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (see, e.g., Baldino et al., *Methods Enzymology* 168:761-777; Bolton et al., 1962, *Proc. Natl. Acad. Sci. USA* 48:1390; Bresslauer et al., 1986, *Proc. Natl. Acad. Sci. USA* 83:8893-8897; Freier et al., 1986, *Proc. Natl. Acad. Sci. USA* 83:9373-9377; Kierzek et al., *Biochemistry* 25:7840-7846; Rychlik et al., 1990, *Nucleic Acids Res* 18:6409-6412 (erratum, 1991, *Nucleic Acids Res* 19:698); Sambrook et al., supra); Suggs et al., 1981, In *Developmental Biology Using Purified Genes* (Brown et al., eds.), pp. 683-693, Academic Press; and Wetmur, 1991, *Crit. Rev Biochem Mol Biol* 26:227-259. All publications incorporate herein by reference). In some embodiments, the polynucleotide encodes the polypeptide disclosed herein and hybridizes under defined conditions, such as moderately stringent or highly stringent conditions, to the complement of a sequence encoding an engineered PGA enzyme of the present disclosure.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA; with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Heterologous" polynucleotide refers to any polynucleotide that is introduced into a host cell by laboratory techniques, and includes polynucleotides that are removed from a host cell, subjected to laboratory manipulation, and then reintroduced into a host cell.

"Codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the PGAs enzymes may be codon optimized for optimal production from the host organism selected for expression.

"Preferred, optimal, high codon usage bias codons" refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (see GCG CodonPreference, Genetics Computer Group Wisconsin Package; CodonW, John Peden, University of Nottingham; McInerney, J. O, 1998, *Bioinformatics* 14:372-73; Stenico et al., 1994, Nucleic Acids Res. 222437-46; Wright, F., 1990, *Gene* 87:23-29). Codon usage tables are available for a growing list of organisms (see for example, Wada et al., 1992, *Nucleic Acids Res.* 20:2111-2118; Nakamura et al., 2000, *Nucl. Acids Res.* 28:292; Duret, et al., supra; Henaut and Danchin, "*Escherichia coli* and *Salmonella*," 1996, Neidhardt, et al. Eds., ASM Press, Washington D.C., p. 2047-2066. The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (see for example, Mount, D., *Bioinformatics: Sequence and Genome Analysis*, Chapter 8, Cold Spring Harbor Laboratory Press, Cold Spring Harbor, N.Y., 2001; Uberbacher, E. C., 1996, *Methods Enzymol.* 266:259-281; Tiwari et al., 1997, *Comput. Appl. Biosci.* 13:263-270).

"Control sequence" is defined herein to include all components, which are necessary or advantageous for the expression of a polypeptide of the present disclosure. Each control sequence may be native or foreign to the nucleic acid sequence encoding the polypeptide. Such control sequences include, but are not limited to, a leader, polyadenylation sequence, propeptide sequence, promoter, signal peptide sequence, and transcription terminator.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" is a nucleic acid sequence that is recognized by a host cell for expression of a polynucleotide of interest, such as a coding sequence. The control sequence may comprise an appropriate promoter sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

6.2. Penicillin G Acylases

Penicillin G acylases (PGA) are characterized by the ability to catalyze the hydrolytic cleavage of penicillin G, also known a benzyl penicillin, whose conjugate base is of structural formula (I), to 6-amino penicillanic acid, whose conjugate base is of structural formula (II), and phenylacetic acid of structural formula (III), as shown in Scheme 1:

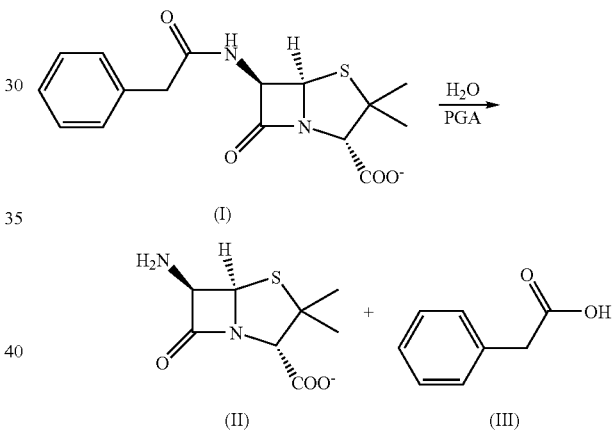

While not being bound by theory, substrate specificity appears associated with recognition of the hydrophobic phenyl group while a nucleophile, which in some PGAs is a serine residue at the N-terminus of the β-chain acts as the acceptor of β-lactam and a variety of other groups, such as β-aminoacids. PGAs can also be characterized by the ability to cleave a model substrates analogous to penicillin G, for instance cleavage of 6-nitro-3-(phenylacetamido)benzoic acid (NIPAB) of structural formula (IV), as shown in Scheme 2,

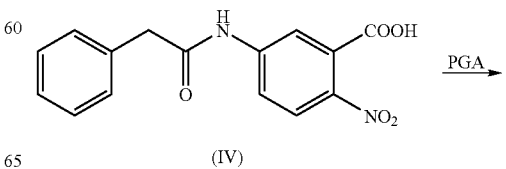

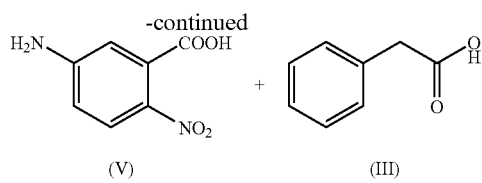

to phenylacetic acid of structural formula (III) and 5-amino-2-nitro-benzoic acid of structural formula (V) (see Alkema et al, 1999, "The use of chromogenic reference substrates for the kinetic analysis of penicillin acylases," *Anal. Biochem.* 275, 47-53). Because the 5-amino-2-nitro-benzoic acid is chromogenic, the substrate of formula (IV) provides a convenient way of measuring PGA activity. In addition to the foregoing reactions, PGAs can also be used in the kinetic resolution of DL-tert leucine for the preparation of optically pure tert leucine (see Liu et al., 2006, *Prep Biochem Biotechnol.* 36 (3):235-41).

The PGAs of the present disclosure are based on the enzyme obtained from the organism *Kluyvera citrophila* (*K. citrophila*). As with PGAs from other organisms, the PGA of *K. citrophila* is a heterodimeric enzyme comprised of an α-subunit and a β-subunit that is generated by proteolytic processing of a pre-pro-PGA polypeptide. Removal of a signal peptide and a spacer peptide produces the mature heterodimer (see e.g., Barbero et al., 1986, *Gene* 49(1):69-80). The amino acid sequence of the naturally occurring pre-pro-PGA polypeptide of *K. citrophila* is publicly available (see e.g., Genbank accession No. P07941, [gi:129551]) and is provided herein as SEQ ID NO:2. The α-chain sequence of the naturally occurring *K citrophila* PGA corresponds to residues 27 to 235 of SEQ ID NO: 2 and has the amino acid sequence of SEQ ID NO: 179. The β-chain sequence of the naturally occurring *K. citrophila* PGA corresponds to residues 290 to 846 of SEQ ID NO:2 and has the amino acid sequence of SEQ ID NO:180. Residues 1 to 26 of SEQ ID NO:2 correspond to the signal peptide and residues 236-289 of SEQ ID NO:2 correspond to the linking propeptide, both of which are removed to generate the naturally occurring mature PGA enzyme which is a heterodimer comprising an α-chain subunit of SEQ ID NO: 179 and a β-chain subunit of SEQ ID NO: 180.

In various embodiments, the PGA polypeptides of the disclosure can be described in reference to the amino acid sequence of an engineered single chain PGA represented by SEQ ID NO:32, as further described below. In the reference single chain PGA of SEQ ID NO:32, residues 1 to 555 correspond to the naturally occurring β-chain sequence with two carboxy terminal amino acid residues deleted (i.e., residues 1-555 of SEQ ID NO: 32 correspond to residues 290-844 of SEQ ID NO: 2), and residues 560 to 764 correspond to the naturally occurring α-chain sequence with four amino terminal amino acid residues deleted (i.e., residues 560-764 of SEQ ID NO: 32 correspond to residues 31-235 of SEQ ID NO: 2). Residues 556 to 559 of SEQ ID NO: 32 are a four amino acid linker/spacer that links the β-chain sequence to the α-chain sequence to form the single chain construct.

The amino acid residue position at which a particular amino acid or amino acid change is present in an amino acid sequence is sometimes described herein in terms "Xn", or "position n", where n refers to the residue position. A substitution mutation, which is a replacement of an amino acid residue in the reference sequence with a different amino acid residue may be denoted by the symbol "→". While the features in the amino acid sequences for various engineered PGA enzymes may be described herein in reference to the position numbering of the single chain PGA (i.e., SEQ ID NO:32), these features are readily extrapolated to engineered heterodimeric PGA enzymes with separate α- and β-chains. For instance, the residue corresponding to X24 of the single chain PGA sequence of SEQ ID NO: 32 is position 313 in the β-chain sequence of the naturally occurring PGA represented by SEQ ID NO:2. Hence, the descriptions for the features at various residue positions of the single chain PGA are also contemplated for the heteromeric PGAs that can be formed from separate α- and β-chain subunits.

The engineered PGA enzymes disclosed herein have various differences in the structure and amino acid sequence that result in improved enzyme properties as compared to the naturally occurring mature PGA enzyme generated from the pre-pro-PGA of SEQ ID NO: 2, comprising a heterodimer of the naturally occurring α-chain sequence (SEQ ID NO: 179) and the naturally occurring β-chain sequence (SEQ ID NO: 180). In some embodiments, the improved property of the engineered PGA polypeptide is with respect to an increase in its rate of conversion of a substrate to a product, which can be manifested by the ability to use less of the improved polypeptide as compared to the wild-type or other reference sequence to reduce or convert the same amount of product. In some embodiments, the improved property of the PGA polypeptide is with respect to its stability or thermostability. In some embodiments, the improved property is a change of the substrate specificity. In some embodiments, the PGA polypeptide has more than one improved property, such as increased stereospecificity and improved enzymatic activity.

In some embodiments, the engineered PGA enzymes of the disclosure have a structure analogous to the naturally occurring PGAs, where the α-chain and β-chain are separate polypeptide subunits that interact to form a functional PGA (e.g., heterodimer, or higher order heteromer). In some embodiments, the α-chain and/or the β-chain can comprise an α-chain sequence and/or β-chain sequence of an engineered PGA polypeptide that has one or more residue differences as compared to the amino acid sequences of the α-chain sequence and/or β-chain sequence of the naturally occurring PGA of *K. citrophila* (i.e., SEQ ID NOs: 179 and 180). In some embodiments, the engineered PGA can have one or more improved enzymes properties as compared to the naturally occurring mature PGA comprising a heterodimer of the naturally occurring α-chain sequence (SEQ ID NO: 179) and the naturally occurring β-chain sequence (SEQ ID NO: 180).

In some embodiments, the engineered PGA enzyme comprises a single chain (sc) polypeptide, from the amino to carboxy terminus, the structure

B-L-A wherein B is the β chain sequence (or B unit); A is the α chain sequence (or A unit); and L is a linker connecting the β chain sequence to the α chain sequence. In some embodiments, the B unit corresponds to the sequence of SEQ ID NO:180 with the two carboxy terminal amino acid residues deleted and the A unit comprises the sequence of SEQ ID NO:179 with the four amino terminal amino acid residues deleted (i.e., as these sequences are used in the single chain construct of SEQ ID NO: 32). In some embodiments, the spacer or linker L, which is described in more detail below, comprises a spacer or linker of sufficient length and flexibility to permit proper folding and interaction of the A and B units to form a functional PGA enzyme. An exemplary single chain PGA is represented by the sequence of SEQ ID NO: 32 described above.

Whether the engineered PGA enzyme is composed of separate α and β chains or whether the enzyme is formed as a single chain structure as described herein, various differences in the amino acid sequence can be present in the α-chain and/or β-chain sequences. As noted above, in some embodiments, the differences in the amino acid sequence provides an improved enzymatic property as compared to the PGA activity of the naturally occurring enzyme of *K. citrophila*, or another engineered PGA, for example the polypeptide of SEQ ID NO:32. It is to be understood that improvements in one enzyme property is not exclusive of improvements in a different enzyme properties such that the same defined differences from the naturally occurring PGA enzyme can result in more than one improved property, such as an increase in enzymatic activity and an increase in solvent or thermostability.

In accordance with the above, in some embodiments, a PGA enzyme capable of cleaving the substrate penicillin G or NIPAB to their corresponding products, can comprise an α-chain sequence (A unit) and a β-chain sequence (B unit), wherein the α-chain sequence comprises an amino acid sequence having at least 85%, 86%, 87%, 88%, 89%, 90%, 91%, 92%, 93%, 94%, 95%, 96%, 97%, 98%, 99% or more identity to SEQ ID NO:179, and the β-chain sequence comprises an amino acid sequence having at least 85%, 86%, 87%, 88%, 89%, 90%, 91%, 92%, 93%, 94%, 95%, 96%, 97%, 98%, 99% or more identity to SEQ ID NO:180, where the PGA enzyme has an improved property as compared to the naturally occurring PGA enzyme of *K. citrophila*. As noted above, the sequence of SEQ ID NO:179 corresponds to residues 27 to 235 of the pre-pro-PGA sequence of SEQ ID NO:2, and represents the α-chain sequence of the naturally occurring PGA of *K. citrophila*. The sequence of SEQ ID NO:180 corresponds to residues 290 to 844 of the pre-pro-PGA sequence of SEQ ID NO:2, and represents the β-chain sequence of the naturally occurring PGA of *K citrophila*.

In some embodiments, a PGA polypeptide capable of cleaving the substrates to the corresponding products can comprise an amino acid sequence having one or more residue differences as compared to the amino acid sequence of the α-chain sequence and/or β-chain sequence of the PGA of *K. citrophila*. The residue differences can be limited to the corresponding a chain sequence, limited to the β-chain sequence, or be present in both the α and β chain sequences of the engineered PGA. In some embodiments, the residue differences are present in a single chain PGA. In some embodiments, the residue differences can include amino acid substitutions, deletions, insertions, or various combinations thereof. Any one or a combination of residue differences can be present to generate the engineered enzymes. In such embodiments, the number of residue differences can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 10% of the total number of amino acids, up to 15% of the total number of amino acids, up to 20% of the total number of amino acids, or up to 30% of the total number of amino acids of the reference polypeptide sequence. In some embodiments, the number of residue differences to the reference sequence can comprise a 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 modifications in the reference PGA polypeptide sequence (i.e., α-chain and β-chain sequences). In some embodiments, the number of modifications can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues. The modifications can comprise insertions, deletions, substitutions, or combinations thereof.

In some embodiments, the residue differences can comprise amino acid substitutions. Substitutions can be at one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 10% of the total number of amino acids, up to 20% of the total number of amino acids, or up to 30% of the total number of amino acids of the reference enzyme sequence. In some embodiments, the number of substitutions can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 amino acid substitutions as compared to the reference sequence. In some embodiments, the number of substitutions can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues.

In some embodiments, a PGA polypeptide capable of cleaving the substrate penicillin G or NIPAB to the corresponding products, can comprise an A unit and a B unit, wherein the A-unit comprises an amino acid sequence having at least 85%, 86%, 87%, 88%, 89%, 90%, 91%, 92%, 93%, 94%, 95%, 96%, 97%, 98%, 99% or more identity to residues 560 to 764 of the engineered PGA of SEQ ID NO:130 and the B-unit comprises an amino acid sequence having at least 85%, 86%, 87%, 88%, 89%, 90%, 91%, 92%, 93%, 94%, 95%, 96%, 97%, 98%, 99% or more identity to residues 1 to 555 of the engineered PGA of SEQ ID NO:130. In some embodiments, these PGA polypeptides can have one or more residue differences at other residue positions as compared to the reference amino acid sequence. The differences can include various modifications, such as substitutions, deletions, and insertions. The substitutions can be non-conservative substitutions, conservative substitutions, or a combination of non-conservative and conservative substitutions. In some embodiments, these PGA polypeptides can have optionally from about 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residues as compared to the reference sequence. In some embodiments, the number of difference can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residues as compared to the reference sequence. In some embodiments, the reference sequence is SEQ ID NO:130.

In some embodiments, the PGA polypeptide can be based on the sequence formula of SEQ ID NO:181. The sequence formula of SEQ ID NO:181 is based on the single chain PGA sequence of SEQ ID NO:32. As noted herein, residues 1 to 555 correspond to the β-chain sequence with two carboxy terminal amino acid residues deleted from the β-chain sequence of the naturally occurring PGA represented by SEQ ID NO:2, and residues 560 to 764 correspond to the α-chain sequence, with four amino terminal amino acid residues deleted from the α-chain sequence of the naturally occurring PGA represented by SEQ ID NO:2. In the sequence formula of SEQ ID NO:181, has the following features: residue corresponding to X24 is an aromatic, non-polar or aliphatic residue; residue corresponding to X26 is a cysteine or aromatic residue; residue corresponding to X27 is a cysteine or an aromatic residue; residue corresponding to X28 is a non-polar, aliphatic, or polar residue; residue corresponding to X29 is a constrained or polar residue; residue corresponding to X31 is a cysteine, constrained, aromatic, non-polar, aliphatic, polar, or basic residue; residue corresponding to X56 is a non-polar, aliphatic or polar residue; residue corresponding to X71 is a cysteine, basic, acidic, aromatic, non-polar, aliphatic or polar residue; residue corresponding to X74 is an acidic, non-polar, or aliphatic residue; residue corresponding to X77 is a non-polar, aliphatic or polar residue; residue corresponding to X119 is an aromatic or basic residue; residue corresponding to X129 is a polar, non-polar or aliphatic residue; residue corresponding to X146 is a basic or acidic residue; residue corresponding to X154 is an aromatic residue; residue corresponding to X164 is a constrained or polar residue; residue corresponding to X177 is a non-polar, aliphatic or polar residue; residue corresponding to X225 is a non-polar or aliphatic residue; residue corresponding to X240 is an aromatic or basic residue; residue corresponding to X264 is a non-polar or aliphatic residue; residue corresponding to X270 is a non-polar or aliphatic residue; residue corresponding to X308 is a non-polar, aliphatic, or polar residue; residue corresponding to X321 is a polar or acidic residue; residue corresponding to X322 is a basic residue; residue corresponding to X340 is a polar or basic residue; residue corresponding to X352 is a polar residue; residue corresponding to X379 is a polar, non-polar or aliphatic residue; residue corresponding to X386 is a polar or constrained residue; residue corresponding to X391 is a non-polar or aliphatic residue; residue corresponding to X410 is a non-polar, aliphatic or constrained residue; residue corresponding to X423 is a non-polar, aliphatic or polar residue; residue corresponding to X431 is an aromatic or basic residue; residue corresponding to X457 is an aromatic or polar residue; residue corresponding to X483 is a polar residue; residue corresponding to X484 is a polar or acidic residue; residue corresponding to X501 is a polar or acidic residue; residue corresponding to X511 is a non-polar, aliphatic, or aromatic residue; residue corresponding to X547 is a basic or polar residue; residue corresponding to X658 is an aromatic or basic residue; residue corresponding to X697 is a non-polar, aliphatic, or aromatic residue; residue corresponding to X701 is a cysteine, aromatic, constrained, non-polar, or aliphatic residue; residue corresponding to X711 is a non-polar, aliphatic or polar residue; residue corresponding to X729 is a non-polar, aliphatic, or aromatic residue; residue corresponding to X750 is a non-polar or polar residue; and residue corresponding to X754 is a non-polar, aliphatic or constrained residue. In some embodiments, the polypeptides comprising an amino acid sequence that is based on the sequence formula of SEQ ID NO:181 can have additionally one or more residue differences at residue positions not specified by an X above as compared to the reference α- and β-chain sequence of SEQ ID NO:2. In some embodiments, the differences can be 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions not defined by X above. In some embodiments, the number of differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions. In some embodiments, the differences comprise conservative mutations.

In some embodiments, the sequence formula of SEQ ID NO:181 has the following features: residue corresponding to X24 is tyrosine, phenylalanine, tryptophan, glycine, methionine, alanine, valine, leucine, or isoleucine, particularly tyrosine or alanine; residue corresponding to X26 is cysteine, tyrosine, phenylalanine, or tryptophan, particularly cysteine; residue corresponding to X27 is cysteine, tyrosine, phenylalanine, or tryptophan, particularly cysteine; residue corresponding to X28 is glycine, methionine, alanine, valine, leucine, or isoleucine, serine, threonine, glutamine, or asparagine, particularly valine or threonine; residue corresponding to X29 is proline, histidine, serine, threonine, glutamine or asparagine, particularly serine; residue corresponding to X31 is cysteine, proline, histidine, tyrosine, phenylalanine, tryptophan, glycine, methionine, alanine, valine, leucine, isoleucine, serine, threonine, glutamine, asparagine, arginine, or lysine, particularly phenylalanine, tryptophan, leucine, valine, threonine, cysteine, asparagine, methionine, or lysine; residue corresponding to X56 is glycine, methionine, alanine, valine, leucine, isoleucine, serine, threonine, glutamine, or asparagine, particularly threonine, isoleucine, leucine; residue corresponding to X71 is cysteine, glycine, methionine, alanine, valine, leucine, isoleucine, serine, threonine, glutamine or asparagine, particularly glycine, leucine, valine, cysteine, lysine, arginine, glutamine, or glutamic acid; residue corresponding to X74 is glycine, methionine, alanine, valine, leucine, or isoleucine, particularly glycine; residue corresponding to X77 is glycine, methionine, alanine, valine, leucine, isoleucine, serine, threonine, glutamine, or asparagine, particularly threonine; residue corresponding to X119 is tyrosine, phenylalanine, tryptophan, lysine, or arginine, particularly arginine; residue corresponding to X129 is serine, threonine, glutamine, asparagine, glycine, methionine, alanine, valine, leucine, or isoleucine, particularly alanine; residue corresponding to X146 is arginine, lysine, aspartic acid or glutamic acid, particularly glutamic acid; residue corresponding to X154 is tyrosine, phenylalanine, or tryptophan, particularly phenylalanine; residue corresponding to X164 is proline, histidine, serine, threonine, glutamine or asparagine, particularly serine; residue corresponding to X177 is glycine, methionine, alanine, valine, leucine, isoleucine, serine, threonine, glutamine, or asparagine, particularly threonine; residue corresponding to X225 is glycine, methionine, alanine, valine, leucine, or isoleucine, particularly valine; residue corresponding to X240 is tyrosine, phenylalanine, tryptophan, lysine or arginine, particularly arginine; residue corresponding to X264 is glycine, methionine, alanine, valine, leucine, or isoleucine, particularly alanine; residue corresponding to X270 is a glycine, methionine, alanine, valine, leucine, or isoleucine, particularly valine; residue corresponding to X308 is glycine, methionine, alanine, valine, leucine, isoleucine, serine, threonine, glutamine or asparagine, particularly threonine; residue corresponding to X321 is serine, threonine, glutamine, asparagine, glutamic acid, or aspartic acid, particularly asparagine; residue corresponding to X322 is lysine or arginine, particularly arginine; residue corresponding to X340 is serine, threonine, glutamine, asparagine, lysine, or arginine, particularly arginine; residue corresponding to X352 is serine, threonine, glutamine, or asparagine, particularly serine; residue corresponding to X379 is serine, threonine, glutamine, asparagine, glycine, methionine, alanine, valine, leucine, or isoleucine, particularly alanine; residue corresponding to X386 is serine, threonine, glutamine, asparagine, histidine, or proline, particularly proline; residue corresponding to X391 is glycine, methionine, alanine, valine, leucine, or isoleucine, particularly glycine; residue corresponding to X410 is glycine, methionine, alanine, valine, leucine, isoleucine, histidine, or proline, particularly proline; residue corresponding to X423 is glycine, methionine, alanine, valine, leucine, isoleucine, serine, threonine, glutamine, or asparagine, particularly threonine; residue corresponding to X431 is tyrosine, phenylalanine, tryptophan, arginine, or lysine, particularly arginine; residue corresponding to X457 is tyrosine, phenylalanine, tryptophan, serine, threonine, glutamine, or asparagine, particularly tyrosine; residue corresponding to X483 is serine, threonine, alanine, valine, leucine, or isoleucine, particularly serine; residue corresponding to X484 is serine, threonine, glutamine, asparagine, glutamic acid, or aspartic acid, particularly asparagine; residue corresponding to X501 is serine, threonine, glutamine, asparagine, glutamic acid, or aspartic acid, particularly asparagine; residue corresponding to X511 is glycine, methionine, alanine, valine, leucine, isoleucine, tyrosine, phenylalanine, or tryptophan, particularly phenylalanine; residue corresponding to X547 is arginine, lysine, serine, threonine, glutamine, or asparagine, particularly glutamine; residue corresponding to X658 is tyrosine, phenylalanine, tryptophan, lysine, or arginine, particularly arginine; residue corresponding to X697 is glycine, methionine, alanine, valine, leucine, isoleucine, tyrosine, phenylalanine, or tryptophan, particularly leucine, phenylalanine, glycine; residue corresponding to X701 is cysteine, tyrosine, phenylalanine, tryptophan, histidine, proline, glycine, methionine, alanine, valine, leucine, isoleucine, particularly tryptophan, histidine, tyrosine, leucine, or valine; residue corresponding to X711 is glycine, methionine, alanine, valine, leucine, isoleucine, serine, threonine, glutamine or asparagine, particularly glutamine; residue corresponding to X729 is glycine, methionine, alanine, valine, leucine, isoleucine, tyrosine, phenylalanine, or tryptophan, particularly phenylalanine; residue corresponding to X750 is glycine, methionine, alanine, valine, leucine, isoleucine, serine, threonine, glutamine, or asparagine, particularly glycine; and residue corresponding to X754 is glycine, methionine, alanine, valine, leucine, isoleucine, histidine, or proline, particularly proline. In some embodiments, the PGAs with increased enzymatic activity can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions. In some embodiments, the differences comprise conservative mutations.

In some embodiments, the PGAs described herein have an improved enzymatic activity as compared to the naturally occurring PGA of *K citrophila* or the engineered single chain PGA of SEQ ID NO:32. In some embodiments, the improvement in enzymatic activity can be at least 1.5 times, 2 times, 2.5 times, 3 times, 4 times, 5 times, 10 times, 20 times, 25 times or more times the enzymatic activity of the naturally occurring PGA enzyme of *K. citrophila*. In some embodiments, the improvements in enzymatic activity is with respect to cleavage of NIPAB to the corresponding 5-amino-3-nitrobenzoic acid and phenylacetic acid.

In some embodiments, the PGA polypeptides with improved enzymatic activity comprises an amino acid sequence, based on the sequence formula of SEQ ID NO:181, having one or more of the following features: residue corresponding to X24 is a non-polar, aliphatic or aromatic residue; residue corresponding to X28 is a non-polar, aliphatic or polar residue, particularly a non-polar or aliphatic residue; residue corresponding to X31 is a cysteine, constrained, aromatic, non-polar, aliphatic, polar, or basic residue, particularly cysteine, constrained, non-polar or aliphatic residue; residue corresponding to X56 is a non-polar, aliphatic, or polar residue; residue corresponding to X71 is a cysteine, basic, acidic, aromatic, non-polar, aliphatic or polar residue, particularly cysteine, basic, acidic, non-polar, aliphatic or polar residue; residue corresponding to X74 is an acidic, non-polar or aliphatic residue, particularly non-polar or aliphatic residue; residue corresponding to X547 is a basic or polar residue, particularly a polar residue; residue corresponding to X697 is non-polar, aliphatic, or aromatic residue; and residue corresponding to X701 is an aromatic residue. In some embodiments, the PGA polypeptides with increased enzymatic activity can have, independently of or in addition to the preceding features, one or more of the following features: residue corresponding to X26 is a cysteine or aromatic residue; residue corresponding to X27 is a cysteine or an aromatic residue; residue corresponding to X154 is an aromatic residue; residue corresponding to X164 is a constrained or polar residue, particularly a polar residue; residue corresponding to X177 is a non-polar, aliphatic, or polar residue, particularly a polar residue; residue corresponding to X423 is a non-polar, aliphatic or polar residue, particularly a polar residue; residue corresponding to X431 is an aromatic or basic residue, particularly a basic residue; residue corresponding to X457 is a polar or aromatic residue, particularly an aromatic residue; residue corresponding to X484 is an acidic or polar residue, particularly a polar residue; residue corresponding to X501 is an acidic or polar residue, particularly a polar residue; residue corresponding to X729 is a non-polar aliphatic, or aromatic residue, particularly an aromatic residue; and residue corresponding to X754 is a non-polar, aliphatic, or constrained residue, particularly a constrained residue. In some embodiments, the PGAs with increased enzymatic activity can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions.

In some embodiments, the PGAs described herein having an improved enzymatic activity as compared to the naturally occurring PGA of *K citrophila* or the engineered single chain PGA of SEQ ID NO:32. can have one or more of the following features, as described above: residue corresponding to X24 is glycine, methionine, alanine, valine, leucine, isoleucine, phenylalanine, tyrosine, or tryptophan, particularly alanine or tyrosine; residue corresponding to X28 is a glycine, methionine, alanine, valine, leucine, or isoleucine, particularly valine; residue corresponding to X31 is cysteine, glycine, methionine, alanine, valine, leucine, isoleucine, serine, threonine, glutamine, or asparagine, particularly cysteine, asparagine, threonine, or valine; residue corresponding to X56 is a glycine, methionine, alanine, valine, leucine, isoleucine, serine, threonine, glutamine, or asparagine, particularly isoleucine, leucine, or threonine; residue corresponding to X71 is a cysteine, serine, threonine, glutamine, asparagine, glycine, methionine, alanine, valine, leucine, isoleucine, aspartic acid, glutamic acid, arginine, or lysine, particularly cysteine, glycine, glutamine, leucine, valine, lysine, arginine, or glutamic acid; residue corresponding to X74 is glycine, methionine, alanine, valine, leucine, isoleucine, glutamic acid, or aspartic acid, particularly glycine; residue corresponding to X547 is a serine, threonine, glutamine, or asparagine, particularly glutamine; residue corresponding to X697 is an tyrosine, phenylalanine, tryptophan, glycine, methionine, alanine, valine, leucine, or isoleucine, particularly phenylalanine, glycine, or leucine; and residue corresponding to X701 is tyrosine, phenylalanine, or tryptophan, particularly tyrosine or tryptophan. In some embodiments, the PGA polypeptides with increased enzymatic activity can have, independently of or in addition to the preceding features, one or more of the following features: residue corresponding to X26 is a cysteine, tyrosine, phenylalanine, or tryptophan, particularly cysteine; residue corresponding to X27 is tyrosine, phenylalanine, tryptophan, or cysteine, particularly cysteine; residue corresponding to X154 is an tyrosine, phenylalanine, or tryptophan, particularly phenylalanine; residue corresponding to X164 is a proline, histidine, serine, threonine, glutamine, or asparagine, particularly serine; residue corresponding to X177 is a serine, threonine, glutamine, asparagine, glycine, methionine, alanine, valine, leucine, or isoleucine, particularly threonine; residue corresponding to X423 is a glycine, methionine, alanine, valine, leucine, isoleucine, serine, threonine, glutamine, or asparagine, particularly threonine; residue corresponding to X431 is tyrosine, phenylalanine, tryptophan, lysine or arginine, particularly lysine or arginine; residue corresponding to X457 is serine, threonine, glutamine, asparagine, tyrosine, phenylalanine, or tryptophan, particularly tyrosine; residue corresponding to X484 is glutamic acid, aspartic acid, serine, threonine, alanine, valine, leucine, or isoleucine, particularly asparagine; residue corresponding to X501 is serine, threonine, glutamine, asparagine, aspartic acid, or glutamic acid, particularly glutamine; residue corresponding to X729 is an glycine, methionine, alanine, valine, leucine, isoleucine, tyrosine, phenylalanine, or tryptophan, particularly phenylalanine; and residue corresponding to X754 is a glycine, methionine, alanine, valine, leucine, or isoleucine, histidine or proline, particularly proline. In some embodiments, the PGAs with increased enzymatic activity can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions.

In some embodiments, the engineered PGA polypeptides of the disclosure have changed substrate specificity, as reflected in improvements in the capability of the enzyme to cleave para and/or alpha substituted phenyl and phenoxy acetate esters and amides. In some embodiments, the para substituted phenyl and phenoxy acetate esters and amides have the structure of formula (VI)

Scheme 3

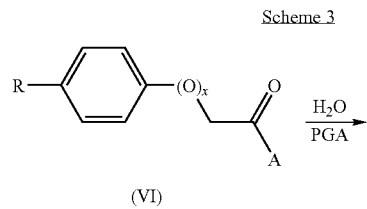

(VI)

-continued

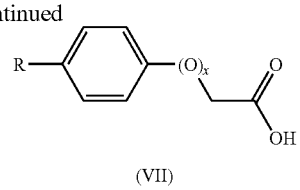

(VII)

wherein, R is —H, —OCH₃, —OH, or Cl, x is 0, 1, A is OR' or NH", wherein R' is lower alkyl, e.g., methyl, ethyl, propyl, and the like, and R" is H or R', and the hydrolytic cleavage reaction mediated by the PGA is shown in Scheme 3.

In some embodiments, the alpha substituted phenyl and phenoxy acetates have the structure of formula (VIII), Scheme 4

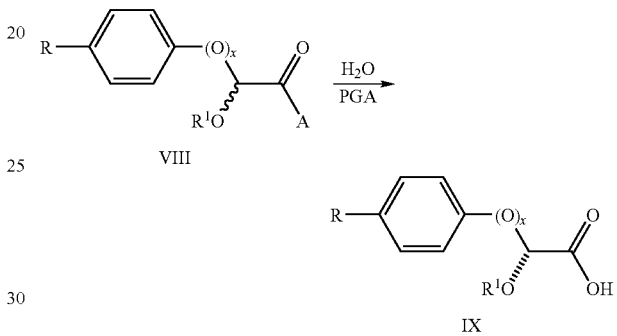

VIII

IX wherein, R, x, and A are as described for the compounds of structural formula (VI) and R' is —OH or OCH₃, and the reaction mediated by the PGA is shown in Scheme 4. When the compound of structural formula (VIII) is a mixture of enantiomers, the reaction may be enantiospecific to react one enantiomer preferentially over the other and effect a kinetic resolution.

In some embodiments, the PGA polypeptides with altered substrate recognition have an amino acid sequence, based on the sequence formula of SEQ ID NO:181, one or more of the following features: residue corresponding to X24 is a non-polar, aliphatic, or aromatic residue; residue corresponding to X28 is a polar, non-polar or aliphatic residue; residue corresponding to X31 is a cysteine, constrained, aromatic, non-polar, aliphatic, polar, or basic residue; residue corresponding to X56 is non-polar, aliphatic or polar residue; residue corresponding to X71 is a cysteine, basic, acidic, aromatic, non-polar, aliphatic or polar residue; residue corresponding to X74 is a non-polar residue, aliphatic, or acidic residue, particularly a non-polar or aliphatic residue; residue corresponding to X547 is a basic or polar residue, particularly a polar residue; residue corresponding to X697 is an aromatic, non-polar or aliphatic residue; and residue corresponding to X701 is a cysteine, aromatic, constrained, non-polar, or aliphatic residue. In some embodiments, the PGA polypeptides with altered substrate recognition can have, independently of or in addition to the preceding features, one or more of the following features: residue corresponding to X26 is a cysteine or aromatic residue; residue corresponding to X27 is a cysteine or aromatic residue; residue corresponding to X29 is a constrained or polar residue, particularly a polar residue; residue corresponding to X119 is an aromatic or basic residue, particularly a basic residue; residue corresponding to X129 is a polar, non-polar or aliphatic residue, particularly a non-polar or aliphatic residue; residue corresponding to X146 is a basic or acidic residues; residue corresponding to X154 is an aromatic residue; residue corresponding to X164 is a constrained or polar residue; residue corresponding to X177 is a non-polar, aliphatic or polar residue; residue corresponding to X225 is a non-polar or aliphatic residue; residue corresponding to X264 is a non-polar or aliphatic residue; residue corresponding to X270 is a non-polar or aliphatic residue; residue corresponding to X308 is a non-polar, aliphatic or polar residue; residue corresponding to X321 is a polar or acidic residue; residue corresponding to X322 is a basic residue; residue corresponding to X340 is a polar or basic residue; residue corresponding to X352 is a polar residue; residue corresponding to X379 is a non-polar, aliphatic or polar residue; residue corresponding to X386 is a polar or constrained residue; residue corresponding to X391 is a non-polar or aliphatic residue; residue corresponding to X410 is a non-polar, aliphatic or constrained residue; residue corresponding to X423 is a non-polar, aliphatic or polar residue; residue corresponding to X431 is an aromatic or basic residue; residue corresponding to X457 is an aromatic or polar residue; residue corresponding to X483 is a polar residue; residue corresponding to X484 is a polar or acidic residue; residue corresponding to X501 is a polar or acidic residue; residue corresponding to X511 is a non-polar, aliphatic or aromatic residue; residue corresponding to X658 is an aromatic or basic residue; residue corresponding to X711 is a non-polar, aliphatic or polar residue; residue corresponding to X729 is a non-polar, aliphatic or aromatic residue; residue corresponding to X750 is a non-polar or polar residue; and residue corresponding to X754 is a non-polar, aliphatic or constrained residue. In some embodiments, the PGAs with changed substrate recognition can have, in addition to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions.

In some embodiments, the PGA polypeptides with changed substrate recognition can have one or more of the following features: residue corresponding to X24 is a glycine, methionine, alanine, valine, leucine, isoleucine, tyrosine, phenylalanine, or tryptophan, particularly tyrosine or alanine; residue corresponding to X28 is a serine, threonine, glutamine, asparagine, glycine, methionine, alanine, valine, leucine, or isoleucine, particularly valine or threonine; residue corresponding to X31 is a proline, histidine, cysteine, tyrosine, phenylalanine, tryptophan, glycine, methionine, alanine, valine, leucine, isoleucine, arginine, lysine, serine, threonine, glutamine, or asparagine, particularly phenylalanine, tryptophan, histidine, leucine, valine, threonine, cysteine, asparagine, methionine, lysine; residue corresponding to X56 is glycine, methionine, alanine, valine, leucine, isoleucine, serine, threonine, glutamine, or asparagine, particularly isoleucine, leucine, or threonine; residue corresponding to X71 is a cysteine, lysine, arginine, aspartic acid, glutamic acid, tyrosine, phenylalanine, tryptophan, glycine, methionine, alanine, valine, leucine, isoleucine, serine threonine, glutamine, or asparagine, particularly cysteine, glycine, arginine, lysine, glutamic acid, leucine, valine, or glutamine; residue corresponding to X74 is glycine, methionine, alanine, valine, leucine, or isoleucine, particularly glycine; residue corresponding to X547 is lysine, arginine, serine, threonine, glutamine, or asparagine, particularly glutamine; residue corresponding to X697 is a tyrosine, phenylalanine, tryptophan, glycine, methionine, alanine, valine, leucine, or isoleucine, particularly phenylalanine, glycine, or leucine; and residue corresponding to X701 is a cysteine, glycine, methionine, alanine, valine, leucine, isoleucine, tyrosine, phenylalanine, tryptophan, proline or histidine, particularly glycine, alanine, valine, leucine, histidine, cysteine, isoleucine, methionine, tyrosine, or tryptophan. In some embodiments, the PGA polypeptides with changed substrate recognition can have, independently of or in addition to the preceding features, one or more of the following features: residue corresponding to X26 is cysteine, tyrosine, phenylalanine, or tryptophan, particularly cysteine; residue corresponding to X27 is cysteine, tyrosine, phenylalanine, or tryptophan, particularly cysteine; residue corresponding to X29 is proline, histidine, serine, threonine, glutamine, or asparagine, particularly serine; residue corresponding to X119 is tyrosine, phenylalanine, tryptophan, lysine or arginine, particularly lysine or arginine; residue corresponding to X129 is glycine, methionine, alanine, valine, leucine, or isoleucine, particularly alanine; residue corresponding to X146 is lysine, arginine, glutamic or aspartic acid, particularly glutamic or aspartic acid; residue corresponding to X154 is tyrosine, phenylalanine, or tryptophan, particularly phenylalanine; residue corresponding to X164 is proline, histidine, serine, threonine, glutamine, or asparagine, particularly serine; residue corresponding to X177 is glycine, methionine, alanine, valine, leucine, isoleucine, serine, threonine, glutamine, or asparagine, particularly threonine; residue corresponding to X225 is glycine, methionine, alanine, valine, leucine, or isoleucine, particularly valine; residue corresponding to X264 is glycine, methionine, alanine, valine, leucine, or isoleucine, particularly alanine, residue corresponding to X270 is glycine, methionine, alanine, valine, leucine, or isoleucine, particularly valine; residue corresponding to X308 is glycine, methionine, alanine, valine, leucine, isoleucine, serine, threonine, glutamine, or asparagine, particularly threonine; residue corresponding to X321 is glutamic acid, aspartic acid, serine, threonine, glutamine, or asparagine, particularly asparagine; residue corresponding to X322 is lysine or arginine; residue corresponding to X340 is serine, threonine, glutamine, asparagine, lysine or arginine, particularly arginine; residue corresponding to X352 is serine, threonine, glutamine, or asparagine, particularly serine; residue corresponding to X379 is serine, threonine, glutamine, asparagine, glycine, methionine, alanine, valine, leucine, or isoleucine, particularly alanine; residue corresponding to X386 is serine, threonine, glutamine, asparagine, proline or histidine, particularly proline; residue corresponding to X391 is glycine, methionine, alanine, valine, leucine, or isoleucine, particularly glycine; residue corresponding to X410 is glycine, methionine, alanine, valine, leucine, isoleucine, histidine or proline, particularly proline; residue corresponding to X423 is glycine, methionine, alanine, valine, leucine, isoleucine, serine, threonine, glutamine, or asparagine, particularly threonine; residue corresponding to X457 is serine, threonine, glutamine, asparagine, tyrosine, phenylalanine, or tryptophan, particularly tyrosine; residue corresponding to X431 is tyrosine, phenylalanine, tryptophan, lysine or arginine, particularly arginine; residue corresponding to X483 is serine, threonine, glutamine, or asparagine, particularly serine; residue corresponding to X484 is glutamic acid, aspartic acid, serine, threonine, glutamine, or asparagine, particularly asparagine; residue corresponding to X501 is glutamic acid, aspartic acid, serine, threonine, glutamine, or asparagine, particularly asparagine; residue corresponding to X511 is glycine, methionine, alanine, valine, leucine, isoleucine, tyrosine, phenylalanine, or tryptophan, particularly phenylalanine; residue corresponding to X658 is tyrosine, phenylalanine, tryptophan, lysine or arginine, particularly arginine; residue corresponding to X711 is glycine, methionine, alanine, valine, leucine, isoleucine, serine, threonine, glutamine, or asparagine, particularly glutamine; residue corresponding to X729 is glycine, methionine, alanine, valine, leucine, isoleucine, tyrosine, phenylalanine, or tryptophan, particularly phenylalanine; residue corresponding to X750 is serine, threonine, glutamine, asparagine, glycine, methionine, alanine, valine, leucine, or isoleucine, particularly glycine; and residue corresponding to X754 is glycine, methionine, alanine, valine, leucine, isoleucine, histidine or proline, particularly proline. In some embodiments, the PGAs with changed substrate recognition can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions. In some embodiments, the differences can comprise conservative substitutions.

In some embodiments, the PGA polypeptides of the disclosure are capable of stereospecific conversion of phenylacetate substrates. In some embodiments, the phenylacetate substrates has the structure of formula (VIII), where the alpha carbon position of the acyl group is chiral. In some embodiments, the polypeptides of the disclosure can have S stereospecificity with respect to the alpha position of the acyl group. In some embodiments, the PGA polypeptides have S stereospecificity with respect to the substrate methyl-α-hydroxy phenylacetic acid ester. In some embodiments, these S stereospecific PGA polypeptides comprises an amino acid sequence having at least the following features: residue corresponding to X71 is a cysteine, non-polar or aliphatic residue; and/or residue corresponding to X701 an aromatic residue, particularly tyrosine or tryptophan. In some embodiments, the S stereospecific PGA polypeptides include, in addition to the features at residues corresponding to X71 and X701, one or more of the following features: residue corresponding to X24 is an aromatic, non-polar or aliphatic residue; residue corresponding to X28 is a non-polar, aliphatic, or polar residue; residue corresponding to X31 is a cysteine, constrained, aromatic, non-polar, polar, aliphatic or basic residue; residue corresponding to X56 is a non-polar, aliphatic or polar residue; residue corresponding to X74 is an acidic, non-polar or aliphatic residue; residue corresponding to X547 is a basic or polar residue; and residue corresponding to X697 is a non-polar, aliphatic, or aromatic residue. In some embodiments, the PGA polypeptides with S stereospecificity can have, independently of or in addition to the preceding features, one or more of the following features: residue corresponding to X26 is a cysteine or aromatic residue; residue corresponding to X27 is a cysteine or an aromatic residue; residue corresponding to X119 is an aromatic or basic residue; residue corresponding to X129 is a polar, non-polar or aliphatic residue; residue corresponding to X146 is a basic or acidic residue; residue corresponding to X154 is an aromatic residue; residue corresponding to X164 is a constrained or polar residue; residue corresponding to X177 is a non-polar, aliphatic or polar residue; residue corresponding to X308 is a non-polar, aliphatic, or polar residue; residue corresponding to X32I is a polar or acidic residue; residue corresponding to X322 is a basic residue; residue corresponding to X379 is a polar, non-polar or aliphatic residue; residue corresponding to X410 is a non-polar, aliphatic or constrained residue; residue corresponding to X43I is an aromatic or basic residue; residue corresponding to X457 is an aromatic or polar residue; residue corresponding to X511 is a non-polar, aliphatic, or aromatic residue; residue corresponding to X658 is an aromatic or basic residue; residue corresponding to X711 is a non-polar, aliphatic or polar residue; residue corresponding to X729 is a non-polar, aliphatic, or aromatic residue; and residue corresponding to X754 is a non-polar, aliphatic or constrained residue. In some embodiments, the PGAs with S stereospecificity can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions. In some embodiments, the differences can comprise conservative mutations.

In some embodiments, the PGA polypeptides of the disclosure are capable of stereospecific conversion of phenylacetate substrates. In some embodiments, the phenylacetate substrates has the structure of formula (VIII), where the alpha carbon position of the acyl group is has a chiral center. In some embodiments, the polypeptides of the disclosure can have S stereospecificity with respect to the alpha position of the acyl group. In some embodiments, the PGA polypeptides have S stereospecificity with respect to the substrate methyl-α-hydroxy phenylacetic acid ester. In some embodiments, these S stereospecific PGA polypeptides comprises an amino acid sequence having at least the following features: residue corresponding to X71 is a cysteine, glycine, methionine, alanine, valine, leucine, or isoleucine, particularly cysteine, glycine, glutamine, glutamic acid; and/or residue corresponding to X701 is tyrosine or tryptophan. In some embodiments, the S stereospecific PGA polypeptides include, in addition to the features at residues corresponding to X71 and X701, one or more of the following features: residue corresponding to X24 is tyrosine, phenylalanine, tryptophan, glycine, methionine, alanine, valine, leucine, or isoleucine, particularly alanine or tyrosine; residue corresponding to X28 is a serine, threonine, glutamine, asparagine, glycine, methionine, alanine, valine, leucine, or isoleucine, particularly valine or threonine; residue corresponding to X56 is glycine, methionine, alanine, valine, leucine, isoleucine, serine, threonine, glutamine, or asparagine, particularly isoleucine, leucine, or threonine; residue corresponding to X74 is glutamic acid, aspartic acid, glycine, methionine, alanine, valine, leucine, or isoleucine, particularly glycine; residue corresponding to X547 is a serine, threonine, glutamine, or asparagine, particularly glutamine; and residue corresponding to X697 is a tyrosine, phenylalanine, tryptophan, glycine, methionine, alanine, valine, leucine, or isoleucine, particularly phenylalanine, glycine, or leucine. In some embodiments, the PGA polypeptides with S stereospecificity can have, independently of or in addition to the preceding features, one or more of the following features: residue corresponding to X26 is a cysteine, tyrosine, phenylalanine, or tryptophan, particularly cysteine; residue corresponding to X27 is a cysteine, tyrosine, phenylalanine, or tryptophan, particularly cysteine; residue corresponding to X119 is tyrosine, phenylalanine, tryptophan, lysine, or arginine, particularly arginine; residue corresponding to X129 is a serine, threonine, glutamine, or asparagine, glycine, methionine, alanine, valine, leucine or isoleucine, particularly alanine; residue corresponding to X146 is lysine, arginine, glutamic acid, or aspartic acid, particularly glutamic acid; residue corresponding to X154 is tyrosine, phenylalanine, or tryptophan, particularly phenylalanine; residue corresponding to X164 is serine, threonine, glutamine, asparagine, histidine, or proline, particularly serine; residue corresponding to X177 is glycine, methionine, alanine, valine, leucine, isoleucine, serine, threonine, glutamine, or asparagine, particularly; residue corresponding to X308 is glycine, methionine, alanine, valine, leucine, isoleucine, serine, threonine, glutamine, or asparagine, particularly threonine; residue corresponding to X32I is serine, threonine, glutamine, asparagine, glutamic acid, or aspartic acid, particularly asparagine; residue corresponding to X322 is lysine or arginine; residue corresponding to X379 is serine, threonine, glutamine, asparagine, glycine, methionine, alanine, valine, leucine, or isoleucine, particularly alanine; residue corresponding to X386 is serine, threonine, glutamine, asparagine, histidine or proline, particularly proline; residue corresponding to X410 is glycine, methionine, alanine, valine, leucine, isoleucine, histidine, or proline, particularly proline; residue corresponding to X423 is glycine, methionine, alanine, valine, leucine, isoleucine, serine, threonine, glutamine, or asparagine, particularly threonine; residue corresponding to X43I is tyrosine, phenylalanine, tryptophan, lysine, or arginine, particularly arginine; residue corresponding to X457 is tyrosine, phenylalanine, tryptophan, serine, threonine, glutamine, or asparagine, particularly tyrosine; residue corresponding to X501 is glutamic acid, aspartic acid, serine, threonine, glutamine, or asparagine, particularly asparagine; residue corresponding to X511 is glycine, methionine, alanine, valine, leucine, isoleucine, tyrosine, phenylalanine, or tryptophan, particularly phenylalanine; residue corresponding to X658 is an tyrosine, phenylalanine, tryptophan, lysine, or arginine, particularly arginine; residue corresponding to X711 is glycine, methionine, alanine, valine, leucine, isoleucine, serine, threonine, glutamine, or asparagine, particularly glutamine; residue corresponding to X729 is glycine, methionine, alanine, valine, leucine, isoleucine, tyrosine, phenylalanine or tryptophan, particularly phenylalanine; and residue corresponding to X754 is glycine, methionine, alanine, valine, phenylalanine, tryptophan, histidine, or proline, particularly proline. In some embodiments, the PGAs with S stereospecificity can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions.

In some embodiments, the polypeptides of the disclosure can have R stereospecificity with respect to the alpha position of the acyl group. In some embodiments, the PGA polypeptides have R stereospecificity with respect to the substrate methyl-α-hydroxy phenylacetic acid ester. In some embodiments, these R stereospecific PGA polypeptides comprises an amino acid sequence having the following features: residue corresponding to X31 is phenylalanine, basic, non-polar, aliphatic or polar residue; and/or residue corresponding to X701 cysteine, phenylalanine, non-polar, aliphatic, or constrained residue. In some embodiments, the R stereospecific PGA polypeptides include, in addition to the features at residues corresponding to X31 and X701, one or more of the following features: residue corresponding to X24 is an aromatic, non-polar or aliphatic residue; residue corresponding to X28 is a non-polar, aliphatic, or polar residue; residue corresponding to X56 is a non-polar, aliphatic or polar residue; residue corresponding to X71 is a cysteine, basic, acidic, aromatic, non-polar, aliphatic or polar residue; residue corresponding to X74 is an acidic, non-polar or aliphatic residue; residue corresponding to X547 is a basic or polar residue; and residue corresponding to X697 is a non-polar, aliphatic, or aromatic residue. In some embodiments, the PGA polypeptides with R stereospecificity can have, independently of or in addition to the preceding features, one or more of the following features: residue corresponding to X26 is a cysteine or aromatic residue; residue corresponding to X27 is a cysteine or an aromatic residue; residue corresponding to X119 is an aromatic or basic residue; residue corresponding to X129 is a polar, non-polar or aliphatic residue; residue corresponding to X146 is a basic or acidic residue; residue corresponding to X154 is an aromatic residue; residue corresponding to X164 is a constrained or polar residue; residue corresponding to X177 is a non-polar or polar residue; residue corresponding to X308 is a non-polar, aliphatic, or polar residue; residue corresponding to X32I is a polar or acidic residue; residue corresponding to X322 is a basic residue; residue corresponding to X379 is a polar, non-polar or aliphatic residue; residue corresponding to X410 is a non-polar, aliphatic or constrained residue; residue corresponding to X43I is an aromatic or basic residue; residue corresponding to X457 is an aromatic or polar residue; residue corresponding to X511 is a non-polar, aliphatic, or aromatic residue; residue corresponding to X658 is an aromatic or basic residue; residue corresponding to X711 is a non-polar, aliphatic or polar residue; residue corresponding to X729 is a non-polar, aliphatic, or aromatic residue; and residue corresponding to X754 is a non-polar, aliphatic or constrained residue. In some embodiments, the PGAs with increased enzymatic activity can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions. In some embodiments, the differences can comprise conservative mutations.

In some embodiments, the PGA polypeptides having R stereospecificity with respect to the alpha position of the acyl donor comprises an amino acid sequence having at least the following features: residue corresponding to X31 is phenylalanine, glycine, methionine, alanine, valine, leucine, isoleucine, serine, threonine, glutamine, or asparagine, lysine, or arginine, particularly phenylalanine, leucine, valine, methionine, asparagine, threonine, cysteine, lysine; and residue corresponding to X701 is cysteine, phenylalanine, glycine, methionine, alanine, valine, leucine, isoleucine, histidine, or proline, particularly histidine, valine, isoleucine, leucine, alanine, cysteine, methionine, or glycine. In some embodiments, the R stereospecific PGA polypeptides include, in addition to the features at residues corresponding to X31 and X701, one or more of the following features: residue corresponding to X24 is tyrosine, phenylalanine, tryptophan, glycine, methionine, alanine, valine, leucine, or isoleucine, particularly alanine or tyrosine; residue corresponding to X28 is a serine, threonine, glutamine, asparagine, glycine, methionine, alanine, valine, leucine, or isoleucine, particularly valine or threonine; residue corresponding to X56 is glycine, methionine, alanine, valine, leucine, isoleucine, serine, threonine, glutamine, or asparagine, particularly isoleucine, leucine, or threonine; residue corresponding to X71 is a cysteine, lysine, arginine, aspartic acid, glutamic acid, tyrosine, phenylalanine, tryptophan, glycine, methionine, alanine, valine, leucine, isoleucine, serine threonine, glutamine, or asparagine, particularly cysteine, glycine, arginine, lysine, glutamic acid, leucine, valine, or glutamine; residue corresponding to X74 is glutamic acid, aspartic acid, glycine, methionine, alanine, valine, leucine, or isoleucine, particularly glycine; residue corresponding to X547 is lysine, arginine, serine, threonine, glutamine, or asparagine, particularly glutamine; and residue corresponding to X697 is a tyrosine, phenylalanine, tryptophan, glycine, methionine, alanine, valine, leucine, or isoleucine, particularly phenylalanine, glycine, or leucine. In some embodiments, the PGA polypeptides with R stereospecificity can have, independently of or in addition to the preceding features, one or more of the following features: residue corresponding to X26 is a cysteine, tyrosine, phenylalanine, or tryptophan, particularly cysteine; residue corresponding to X27 is a cysteine, tyrosine, phenylalanine, or tryptophan, particularly cysteine; residue corresponding to X119 is tyrosine, phenylalanine, tryptophan, lysine, or arginine, particularly arginine; residue corresponding to X129 is a serine, threonine, glutamine, or asparagine, glycine, methionine, alanine, valine, leucine or isoleucine, particularly alanine; residue corresponding to X146 is lysine, arginine, glutamic acid, or aspartic acid, particularly glutamic acid; residue corresponding to X154 is tyrosine, phenylalanine, or tryptophan, particularly phenylalanine; residue corresponding to X164 is serine, threonine, glutamine, asparagine, histidine, or proline, particularly serine; residue corresponding to X177 is glycine, methionine, alanine, valine, leucine, isoleucine, serine, threonine, glutamine, or asparagine, particularly; residue corresponding to X308 is glycine, methionine, alanine, valine, leucine, isoleucine, serine, threonine, glutamine, or asparagine, particularly threonine; residue corresponding to X32I is serine, threonine, glutamine, asparagine, glutamic acid, or aspartic acid, particularly asparagine; residue corresponding to X322 is lysine or arginine; residue corresponding to X379 is serine, threonine, glutamine, asparagine, glycine, methionine, alanine, valine, leucine, or isoleucine, particularly alanine; residue corresponding to X386 is serine, threonine, glutamine, asparagine, histidine or proline, particularly proline; residue corresponding to X410 is glycine, methionine, alanine, valine, leucine, isoleucine, histidine, or proline, particularly proline; residue corresponding to X423 is glycine, methionine, alanine, valine, leucine, isoleucine, serine, threonine, glutamine, or asparagine, particularly threonine; residue corresponding to X43I is tyrosine, phenylalanine, tryptophan, lysine, or arginine, particularly arginine; residue corresponding to X457 is tyrosine, phenylalanine, tryptophan, serine, threonine, glutamine, or asparagine, particularly tyrosine; residue corresponding to X501 is glutamic acid, aspartic acid, serine, threonine, glutamine, or asparagine, particularly asparagine; residue corresponding to X511 is glycine, methionine, alanine, valine, leucine, isoleucine, tyrosine, phenylalanine, or tryptophan, particularly phenylalanine; residue corresponding to X658 is an tyrosine, phenylalanine, tryptophan, lysine, or arginine, particularly arginine; residue corresponding to X711 is glycine, methionine, alanine, valine, leucine, isoleucine, serine, threonine, glutamine, or asparagine, particularly glutamine; residue corresponding to X729 is glycine, methionine, alanine, valine, leucine, isoleucine, tyrosine, phenylalanine or tryptophan, particularly phenylalanine; and residue corresponding to X754 is glycine, methionine, alanine, valine, phenylalanine, tryptophan, histidine, or proline, particularly proline. In some embodiments, the PGAs with R stereospecificity can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions.

In some embodiments, the phenylacetate substrates have the structure of formula (X),

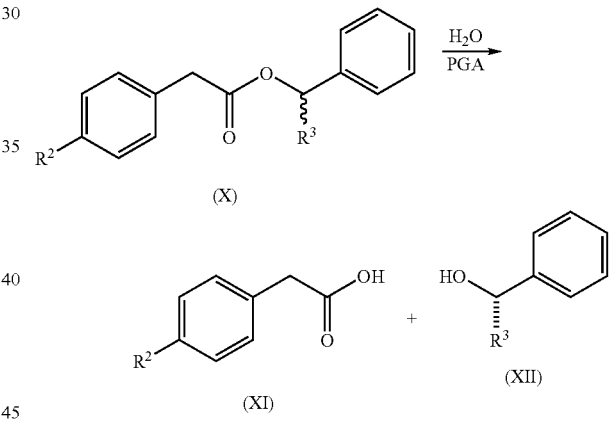

where $R^2$ is H or Cl, $R^3$ is —H, —$CH_3$, or —$CH_2CH_3$, and the PGA mediates the reaction shown in Scheme 6. Specific substrates include the structures of formula (XIII), formula (XIV), formula (XV) and formula (XVI):

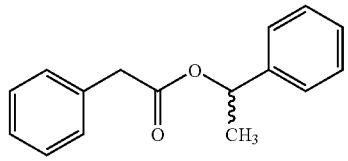

(XIII)

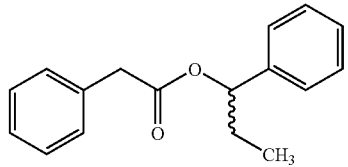

(XIV)

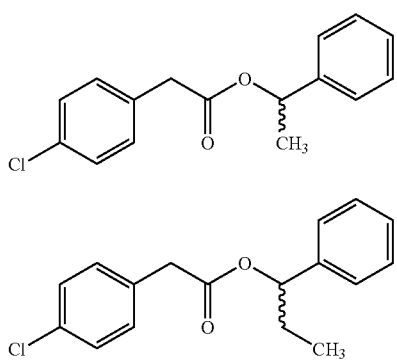

In some embodiments, the PGA polypeptides are capable of stereospecifically cleaving the R stereoisomer of the substrate of structural formula (X) to form the R stereoisomer product of structural formula (XII) in enantiomeric excess (% ee). In some embodiments, the R stereoisomer product can be formed in an enantiomeric excess (% ee) of at least 20%, 30% 40% or 50% or more. In some embodiments, the PGA polypeptides have R stereospecificity with respect to the substrate 1-phenylethyl-2-phenylethylacetate, and comprise an amino acid sequence having one or more of the following features: residue corresponding to X24 is an aromatic, non-polar or aliphatic residue; residue corresponding to X28 is a non-polar, aliphatic, or polar residue; residue corresponding to X31 is a cysteine, constrained, aromatic, non-polar, aliphatic, polar, or basic residue; residue corresponding to X56 is a non-polar, aliphatic or polar residue; residue corresponding to X71 is a cysteine, basic, acidic, aromatic, non-polar, aliphatic or polar residue; residue corresponding to X74 is a non-polar, aliphatic, or acidic residue; residue corresponding to X547 is a basic or polar residue; residue corresponding to X697 is a non-polar, aliphatic, or aromatic residue; and residue corresponding to X701 is a cysteine, phenylalanine, constrained, non-polar, or aliphatic residue. In some embodiments, the PGA polypeptides with R stereospecificity for 1-phenylethyl-2-phenylethylacetate can have, in addition to the preceding features, one or more of the following features: residue corresponding to X26 is a cysteine or aromatic residue; residue corresponding to X119 is an aromatic or basic residue; residue corresponding to X129 is a polar, non-polar or aliphatic residue; residue corresponding to X146 is a basic or acidic residue; residue corresponding to X154 is an aromatic residue; residue corresponding to X177 is a non-polar, aliphatic or polar residue; residue corresponding to X321 is a polar or acidic residue; residue corresponding to X410 is a non-polar, aliphatic or constrained residue; residue corresponding to X431 is an aromatic or basic residue; residue corresponding to X483 is a polar residue; residue corresponding to X511 is a non-polar, aliphatic, or aromatic residue; and residue corresponding to X754 is a non-polar, aliphatic or constrained residue. In some embodiments, the PGAs with R stereospecificity for the acyl donor can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions.

In some embodiments, the PGA polypeptides having R stereospecificity with respect to 1-phenylethyl-2-phenylacetate, comprises an amino acid sequence having one or more of the following features: residue corresponding to X24 is an tyrosine, phenylalanine, tryptophan, glycine, methionine, alanine, valine, leucine, or isoleucine, particularly tyrosine or valine; residue corresponding to X28 is glycine, methionine, alanine, valine, leucine, isoleucine, serine, threonine, glutamine, or asparagine, particularly valine; residue corresponding to X31 is cysteine, histidine, proline, tyrosine, phenylalanine, tryptophan, glycine, methionine, alanine, valine, leucine, isoleucine, serine, threonine, glutamine, asparagine, lysine, or arginine, particularly tyrosine, phenylalanine, leucine, valine, threonine, cysteine, asparagine, or methionine, lysine; residue corresponding to X56 is glycine, methionine, alanine, valine, leucine, isoleucine, serine, threonine, glutamine or asparagine, particularly threonine, isoleucine, or leucine; residue corresponding to X71 is a cysteine, arginine, lysine, glutamic acid, aspartic acid, tyrosine, phenylalanine, tryptophan, glycine, methionine, alanine, valine, leucine, isoleucine, serine, threonine, glutamine, or asparagine, particularly cysteine, glycine, glutamine, leucine, lysine, arginine, or glutamic acid; residue corresponding to X74 is glutamic acid, aspartic acid, glycine, methionine, alanine, valine leucine, or isoleucine, particularly glycine; residue corresponding to X547 is a lysine, arginine, serine, threonine, glutamine, or asparagine, particularly glutamine; residue corresponding to X697 is glycine, methionine, alanine, valine, leucine, isoleucine, tyrosine, phenylalanine, or tryptophan, particularly glycine, leucine, phenylalanine; and residue corresponding to X701 is a cysteine, phenylalanine, histidine, proline, glycine, methionine, alanine, valine, leucine, or isoleucine. In some embodiments, the PGA polypeptides with R stereospecificity for the acyl acceptor can have, independently of or in addition to the preceding features, one or more of the following features: residue corresponding to X26 is a cysteine, tyrosine, or phenylalanine, tryptophan, particularly cysteine; residue corresponding to X119 is tyrosine, phenylalanine, tryptophan, lysine or arginine, particularly arginine; residue corresponding to X129 is serine, threonine, glutamine, asparagine, glycine, methionine, alanine, valine, leucine, or isoleucine, particularly alanine; residue corresponding to X146 is lysine, arginine, glutamic acid or aspartic acid, particularly glutamic acid; residue corresponding to X154 is tyrosine, phenylalanine, or tryptophan, particularly phenylalanine; residue corresponding to X177 is glycine, methionine, alanine, valine, leucine, isoleucine, serine, threonine, glutamine, or asparagine, particularly threonine; residue corresponding to X321 is serine, threonine, glutamine, asparagine, glutamic acid, or aspartic acid, particularly asparagine; residue corresponding to X410 is glycine, methionine, alanine, valine, leucine, isoleucine, histidine, or proline, particularly proline; residue corresponding to X431 is tyrosine, phenylalanine, tryptophan, lysine, or arginine, particularly arginine; residue corresponding to X483 is serine, threonine, glutamine, or asparagine, particularly serine; residue corresponding to X511 is glycine, methionine, alanine, valine, leucine, isoleucine, tyrosine, phenylalanine, or tryptophan, particularly phenylalanine; and residue corresponding to X754 is glycine, methionine, alanine, valine, leucine, isoleucine, histidine, or proline, particularly proline. In some embodiments, the PGAs with R stereospecificity for 1-phenylethyl-2-phenylacetate can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions. In some embodiments, the differences comprises conservative mutations.

In some embodiments, the PGA polypeptides are capable of stereospecifically cleaving the R stereoisomer of the substrate of structural formula (X) to form the S stereoisomer product of structural formula (XII) in enantiomeric excess (% ee). In some embodiments, the S stereoisomer product can be formed in an enantiomeric excess (% ee) of at least 20%, 30% 40% or 50% or more. In some embodiments, the PGA polypeptides have S stereospecificity with respect to the substrate 1-phenylethyl-2-phenylethylacetate, and comprise an amino acid sequence having at least the following features: residue corresponding to X701 is a tyrosine or tryptophan. In some embodiments, the S stereospecific PGA polypeptides can include, in addition to the features at residue corresponding to X701, one or more of the following features: residue corresponding to X24 is an aromatic, non-polar or aliphatic residue; residue corresponding to X28 is a non-polar, aliphatic, or polar residue; residue corresponding to X31 is a cysteine, constrained, aromatic, non-polar, polar, or basic residue; residue corresponding to X56 is a non-polar, aliphatic or polar residue; residue corresponding to X71 is a cysteine, basic, acidic, aromatic, non-polar, aliphatic or polar residue; residue corresponding to X74 is an acidic, non-polar residue or aliphatic residue; residue corresponding to X547 is a basic or polar residue; and residue corresponding to X697 is a non-polar, aliphatic, or aromatic residue. In some embodiments, the PGA polypeptides with R stereospecificity for 1-phenylethyl-2-phenylethylacetate can have, independently of or in addition to the preceding features, one or more of the following features: residue corresponding to X26 is a cysteine or aromatic residue; residue corresponding to X119 is an aromatic or basic residue; residue corresponding to X129 is a polar, non-polar or aliphatic residue; residue corresponding to X146 is a basic or acidic residue; residue corresponding to X177 is a non-polar, aliphatic or polar residue; residue corresponding to X154 is an aromatic residue; residue corresponding to X321 is a polar or acidic residue; residue corresponding to X410 is a non-polar, aliphatic or constrained residue; residue corresponding to X431 is an aromatic or basic residue; residue corresponding to X483 is a polar residue; residue corresponding to X511 is a non-polar, aliphatic, or aromatic residue; and residue corresponding to X754 is a non-polar, aliphatic or constrained residue. In some embodiments, the PGAs with increased enzymatic activity can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions.

In some embodiments, the PGA polypeptides having S stereospecificity with respect to the 1-phenylethyl-2-phenylethylacetate, and having the stated features at the residue corresponding to X701, can include one or more of the following features: residue corresponding to X24 is tyrosine, phenylalanine, tryptophan, glycine, methionine, alanine, valine, leucine, or isoleucine, particularly tyrosine or valine; residue corresponding to X28 is glycine, methionine, alanine, valine, leucine, isoleucine, serine, threonine, glutamine, or asparagine, particularly valine; residue corresponding to X31 is a cysteine, histidine, proline, tyrosine, phenylalanine, tryptophan, glycine, methionine, alanine, valine, leucine, isoleucine, serine, threonine, glutamine, asparagine, lysine, or arginine, particularly tyrosine, phenylalanine, leucine, valine, threonine, cysteine, asparagine, or methionine, lysine; residue corresponding to X56 is glycine, methionine, alanine, valine, leucine, isoleucine, serine, threonine, glutamine or asparagine, particularly threonine, isoleucine, or leucine; residue corresponding to X71 is a cysteine, arginine, lysine, glutamic acid, aspartic acid, tyrosine, phenylalanine, tryptophan, glycine, methionine, alanine, valine, leucine, isoleucine, serine, threonine, glutamine, or asparagine, particularly cysteine, glycine, glutamine, leucine, lysine, arginine, or glutamic acid; residue corresponding to X74 is glutamic acid, aspartic acid, glycine, methionine, alanine, valine leucine, or isoleucine, particularly glycine; residue corresponding to X547 is a lysine, arginine, serine, threonine, glutamine, or asparagine, particularly glutamine; and residue corresponding to X697 is glycine, methionine, alanine, valine, leucine, isoleucine, tyrosine, phenylalanine, or tryptophan, particularly glycine, leucine, phenylalanine. In some embodiments, the PGA polypeptides with R stereospecificity for the acyl acceptor can have, independently of or in addition to the preceding features, one or more of the following features: residue corresponding to X26 is a cysteine, tyrosine, or phenylalanine, tryptophan, particularly cysteine; residue corresponding to X119 is tyrosine, phenylalanine, tryptophan, lysine or arginine, particularly arginine; residue corresponding to X129 is serine, threonine, glutamine, asparagine, glycine, methionine, alanine, valine, leucine, or isoleucine, particularly alanine; residue corresponding to X146 is lysine, arginine, glutamic acid or aspartic acid, particularly glutamic acid; residue corresponding to X154 is tyrosine, phenylalanine, or tryptophan, particularly phenylalanine; residue corresponding to X177 is glycine, methionine, alanine, valine, leucine, isoleucine, serine, threonine, glutamine, or asparagine, particularly threonine; residue corresponding to X321 is serine, threonine, glutamine, asparagine, glutamic acid, or aspartic acid, particularly asparagine; residue corresponding to X410 is glycine, methionine, alanine, valine, leucine, isoleucine, histidine, or proline, particularly proline; residue corresponding to X431 is tyrosine, phenylalanine, tryptophan, lysine, or arginine, particularly arginine; residue corresponding to X483 is serine, threonine, glutamine, or asparagine, particularly serine; residue corresponding to X511 is glycine, methionine, alanine, valine, leucine, isoleucine, tyrosine, phenylalanine, or tryptophan, particularly phenylalanine; and residue corresponding to X754 is glycine, methionine, alanine, valine, leucine, isoleucine, histidine, or proline, particularly proline. In some embodiments, the PGAs with R stereospecificity for 1-phenylethyl-2-phenylacetate can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions. In some embodiments, the differences comprises conservative mutations.

In some embodiments, the PGA polypeptides have an increased solvent and/or thermal stability as compared to the naturally occurring PGA of K. citrophila (e.g., SEQ ID NO:2). The naturally occurring PGA is sensitive to thermal inactivation when treated at 50° C. for about 18 hrs. Under such conditions, the K. citrophila PGA activity is not detectable under the assays conditions of Example 3. Similarly, the naturally occurring PGA is inactivated upon exposure to 48% methanol or 30% acetonitrile at RT for about 18 hrs. In some embodiments, the solvent and/or solvent stable engineered PGAs, comprises an amino acid sequence having one or more of the following features: residue corresponding to X28 is a non-polar, aliphatic, or polar residue, particularly an aliphatic residue, more particularly valine; corresponding to X74 is an acidic, non-polar, or aliphatic residue, particularly a non-polar residue, more particularly glycine and residue corresponding to X547 is a basic or polar residue, particularly a polar residue, more particularly a glutamine. In some embodiments, the solvent and/or thermal stable PGAs can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6,1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions. In some embodiments, the differences comprises conservative mutations. In some embodiments, the PGA polypeptide with improved solvent and/or chemical stability comprises an amino acid sequence that is at least 85%, 86%, 87%, 88%, 89%, 90%, 91%, 92%, 93%, 94%, 95%, 96%, 97%, 98%, 99% or more identical to a reference α and β chain sequence based on SEQ ID NO:2 having the preceding features, with the proviso that the PGA amino acid sequence has at least the preceding features.

In some embodiments, the solvent and/or thermal stable PGAs comprise a single chain PGA of the structure described herein, where the linker or spacer is about four peptides in length. In some embodiments, the linker or spacer has the sequence Gln~Leu~Asp~Gln. An exemplary single chain PGA with increased stability is SEQ ID NO:32. In some embodiments, the solvent and/or thermal stable single chain PGAs can further have the features described above affecting stability (e.g., features at residues X28, X74, and X547). It is to be understood that the features affording solvent and/or thermal stability, in the form of a single chain construct and/or the amino acid sequence features associated with solvent and/or thermal stability, can be combined with other features to generate PGA enzymes with multiple improved properties.

In some embodiments, the engineered PGAs have an improved synthesis/hydrolysis ratio (S/H) as compared to the naturally occurring PGA of K. citrophila (e.g., SEQ ID NO:2). The S/H ratio is important when the PGA enzymes are used in a condensation reactions to synthesize antibiotics such as ampicillin and amoxicillin. For instance, PGAs are used to condense D-phenylglycine ester and p-hydroxy-D-phenylglycine ester with 6-aminopenicillanic acid (6-APA) to form ampicillin and amoxicillin, respectively. Competing side reactions, such as hydrolysis of the side chain ester and secondary hydrolysis of the semi-synthetic β-lactam, can be a disadvantage in this PGA catalyzed reaction. A higher S/H ratio is desirable in these reactions. In some embodiments, the PGA polypeptides of the disclosure have higher S/H ratio as compared to the naturally occurring PGA of K. citrophila. In some embodiments, the S/H ratio is higher than 1.2 based on the assay in Example 5, the reaction of which shown in Scheme 6.

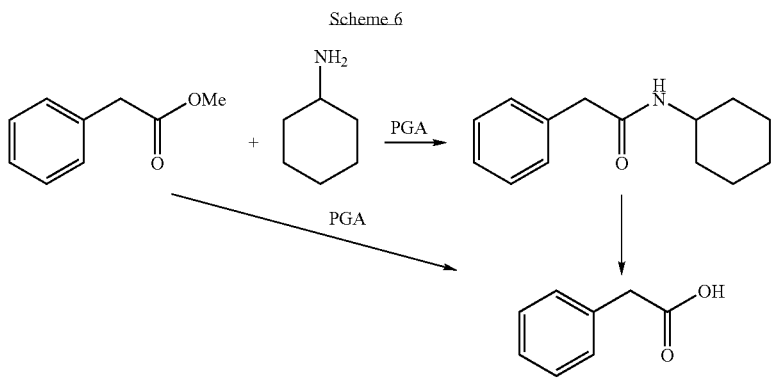

Scheme 6

In some embodiments, a PGA polypeptide with improved S/H ratio is based on the sequence formula of SEQ ID NO:181, and has one or more of the following features: residue corresponding to X7I is a cysteine, non-polar, aliphatic, or basic residue, more particularly cysteine, glycine, lysine, or valine; residue corresponding to X547 is a basic or polar residue, particularly a polar residue, more particularly glutamine; and residue corresponding to X701 is a tyrosine. In some embodiments, the PGAs with improved S/H ratio can have, in addition, to the preceding features, one or more residue differences at other residue positions as compared to the α- and β-chain sequences of SEQ ID NO:2. In some embodiments, the differences can comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residues differences at other residue positions. In some embodiments, the differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acid residues at other residue positions. In some embodiments, the differences comprises conservative mutations. In some embodiments, the PGA polypeptide with improved S/H ratio comprises an amino acid sequence that is at least 85%, 86%, 87%, 88%, 89%, 90%, 91%, 92%, 93%, 94%, 95%, 96%, 97%, 98%, 99% or more identical to a reference α and β chain sequence based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X24 is an aromatic, non-polar or aliphatic residue, particularly tyrosine or alanine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X28 is a non-polar, aliphatic, or polar residue, particularly valine, threonine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference a chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X31 is a cysteine, constrained, aromatic, non-polar, polar, or basic residue, particularly phenylalanine, leucine, valine, threonine, cysteine, asparagine, methionine, lysine, tryptophan, or histidine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X56 is a non-polar, aliphatic or polar residue, particularly leucine, isoleucine, or threonine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequence of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X71 is a cysteine, basic, acidic, aromatic, non-polar, aliphatic or polar residue, particularly leucine, valine, cysteine, lysine, arginine, aspartic acid, glycine, or glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X74 is an acidic, non-polar or aliphatic residue, particularly a non-polar residue, more particularly glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequence. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequence based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X154 is an aromatic residue, particularly phenylalanine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X431 is a basic residue, particularly arginine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X697 is a non-polar, aliphatic, or aromatic residue, particularly leucine, phenylalanine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference a chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X24 is an aromatic, non-polar or aliphatic residue, particularly tyrosine or alanine; and residue corresponding to X28 is a non-polar, aliphatic, or polar residue, particularly valine, threonine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X28 is a non-polar, aliphatic, or polar residue, particularly valine, threonine; and residue corresponding to X31 is a cysteine, constrained, aromatic, non-polar, aliphatic, polar, or basic residue, particularly phenylalanine, leucine, valine, threonine, cysteine, arginine, methionine, lysine, tryptophan, or histidine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X71 is a cysteine, basic, acidic, aromatic, non-polar, aliphatic or polar residue, particularly leucine, valine, cysteine, lysine, arginine, aspartic acid, glycine, or glutamine; and residue corresponding to X74 is an acidic, non-polar or aliphatic residue, particularly a non-polar residue, more particularly glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X71 is a cysteine, basic, acidic, aromatic, non-polar, aliphatic or polar residue, particularly leucine, valine, cysteine, lysine, arginine, aspartic acid, glycine, or glutamine; and residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference a chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X697 is a non-polar, aliphatic, or aromatic residue, particularly leucine, phenylalanine, or glycine; and residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X56 is a non-polar, aliphatic or polar residue, particularly leucine, isoleucine, or threonine; residue corresponding to X71 is a cysteine, basic, acidic, aromatic, non-polar, aliphatic or polar residue, particularly leucine, valine, cysteine, lysine, arginine, aspartic acid, glycine, or glutamine; and residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X24 is an aromatic, non-polar or aliphatic residue, particularly tyrosine or alanine' residue corresponding to X56 is a non-polar, aliphatic or polar residue, particularly leucine, isoleucine, or threonine; and residue corresponding to X71 is a cysteine, basic, acidic, aromatic, non-polar, aliphatic or polar residue, particularly leucine, valine, cysteine, lysine, arginine, aspartic acid, glycine, or glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X24 is an aromatic, non-polar or aliphatic residue, particularly tyrosine or alanine' residue corresponding to X56 is a non-polar, aliphatic or polar residue, particularly leucine, isoleucine, or threonine; and residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X31 is a cysteine, constrained, aromatic, non-polar, polar, or basic residue, particularly phenylalanine, leucine, valine, threonine, cysteine, arginine, methionine, lysine, tryptophan, or histidine; residue corresponding to X56 is a non-polar, aliphatic or polar residue, particularly leucine, isoleucine, or threonine; and residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X56 is a non-polar, aliphatic or polar residue, particularly leucine, isoleucine, or threonine; residue corresponding to X697 is a non-polar, aliphatic, or aromatic residue, particularly leucine, phenylalanine, or glycine; and residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X24 is an aromatic, non-polar or aliphatic residue, particularly tyrosine or alanine; residue corresponding to X71 is a cysteine, basic, acidic, aromatic, non-polar, aliphatic or polar residue, particularly leucine, valine, cysteine, lysine, arginine, aspartic acid, glycine, or glutamine; and residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X24 is an aromatic, non-polar or aliphatic residue, particularly tyrosine or alanine; and residue corresponding to X28 is a non-polar, aliphatic, or polar residue, particularly valine, threonine; residue corresponding to X56 is a non-polar, aliphatic or polar residue, particularly leucine, isoleucine, or threonine; and residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X24 is an aromatic, non-polar or aliphatic residue, particularly tyrosine or alanine; residue corresponding to X56 is a non-polar, aliphatic or polar residue, particularly leucine, isoleucine, or threonine; residue corresponding to X697 is a non-polar, aliphatic, or aromatic residue, particularly leucine, phenylalanine, or glycine; and residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X24 is an aromatic, non-polar or aliphatic residue, particularly tyrosine or alanine; residue corresponding to X31 is a cysteine, constrained, aromatic, non-polar, polar, or basic residue, particularly phenylalanine, leucine, valine, threonine, cysteine, arginine, methionine, lysine, tryptophan, or histidine; residue corresponding to X56 is a non-polar, aliphatic or polar residue, particularly leucine, isoleucine, or threonine; and residue corresponding to X701 is a cysteine, aromatic, constrained, non-polar, or aliphatic residue, particularly tryptophan, histidine, tyrosine, leucine, alanine, valine, histidine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on the sequence formula of SEQ ID NO:181, has at least the following features: residue corresponding to X24 is an aromatic, non-polar or aliphatic residue, particularly tyrosine or alanine; residue corresponding to X31 is a cysteine, constrained, aromatic, non-polar, polar, or basic residue, particularly phenylalanine, leucine, valine, threonine, cysteine, arginine, methionine, lysine, tryptophan, or histidine; residue corresponding to X56 is a non-polar, aliphatic or polar residue, particularly leucine, isoleucine, or threonine; and residue corresponding to X697 is a non-polar, aliphatic, or aromatic residue, particularly leucine, phenylalanine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference a chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features, with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X28 is a non-polar, aliphatic, or polar residue, particularly a non-polar or aliphatic residue, more particularly valine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:4 or 60). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:4 or 60), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X24 is an aromatic, non-polar or aliphatic residue, particularly an aromatic residue, more particularly tyrosine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:8). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:8), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X24 is an aromatic, non-polar or aliphatic residue, particularly a non-polar or aliphatic residue, more particularly alanine; residue corresponding to X28 is a non-polar, aliphatic, or polar residue, particularly a non-polar or aliphatic residue, more particularly valine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:18). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:18), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X28 is a non-polar, aliphatic, or polar residue, particularly a non-polar or aliphatic residue, more particularly valine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X701 is a cysteine, aromatic, constrained, non-polar, or aliphatic residue, more particularly cysteine, glycine, methionine, leucine, alanine, valine, histidine, or tyrosine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:6, 12, 14, 16, 34, 36, 38, 40, 42, or 44). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:6, 12, 14, 16, 34, 36, 38, 40, 42, or 44), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X28 is a non-polar, aliphatic, or polar residue, particularly a non-polar or aliphatic residue, more particularly valine; residue corresponding to X71 is a cysteine, basic, acidic, aromatic, non-polar, aliphatic or polar residue, particularly a cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:20, 22, 24, 26, 28 or 30). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:SEQ ID NO:20, 22, 24, 26, 28 or 30), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X28 is a non-polar, aliphatic, or polar residue, particularly a non-polar or aliphatic residue, more particularly valine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X697 is a non-polar, aliphatic, or aromatic residue, more particularly leucine, phenylalanine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:46, 48, or 50). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β-chain sequences based on SEQ ID NO:2 having the preceding features (e.g., SEQ ID NO:46, 48, or 50), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X28 is a non-polar, aliphatic, or polar residue, particularly a non-polar or aliphatic residue, more particularly valine; residue corresponding to X56 is a non-polar, aliphatic or polar residue, particularly an aliphatic or polar residue, more particularly leucine, isoleucine, or threonine; residue corresponding to X74 is an acidic, non-polar, or aliphatic residue, particularly a non-polar or aliphatic residue, more particularly glycine; and residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:52, 54, or 56). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:52, 54, or 56), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X31 is a cysteine, constrained, aromatic, non-polar, aliphatic, polar, or basic residue, more particularly phenylalanine, leucine, valine, threonine, cysteine, asparagine, methionine, lysine, tryptophan or histidine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:66, 68, 70, 72, 74, 76, 78, or 80). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:66, 68, 70, 72, 74, 76, 78, or 80), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X28 is a non-polar, aliphatic, or polar residue, more particularly valine; residue corresponding to X71 is a cysteine, basic, acidic, aromatic, non-polar, aliphatic or polar residue, particularly cysteine, glutamine, glycine, cysteine, or leucine; residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:82, 84, or 88). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:82, 84, or 88), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X71 is a cysteine, basic, acidic, aromatic, non-polar, aliphatic or polar residue, particularly cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:90). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:90), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X56 is a non-polar, aliphatic or polar residue, particularly an aliphatic or polar residue, more particularly leucine, isoleucine, or threonine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:98). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:98), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X28 is a non-polar, aliphatic, or polar residue, more particularly valine or threonine; residue corresponding to X31 is a cysteine, constrained, aromatic, non-polar, polar, or basic residue, more particularly tryptophan, cysteine, threonine, asparagine, lysine, histidine, phenylalanine, leucine, valine, or methionine; residue corresponding to X56 is a non-polar, aliphatic or polar residue, particularly an aliphatic or polar residue, more particularly leucine, isoleucine, or threonine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:102 or 134). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:102 or 134), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X28 is a non-polar, aliphatic, or polar residue, more particularly valine or threonine; residue corresponding to X56 is a non-polar, aliphatic or polar residue, particularly an aliphatic or polar residue, more particularly leucine, isoleucine, or threonine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:104 or 122). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:104 or 122), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X28 is a non-polar, aliphatic, or polar residue, more particularly valine or threonine; residue corresponding to X71 is a cysteine, basic, acidic, aromatic, non-polar, aliphatic or polar residue, particularly cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:108). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:108), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X28 is a non-polar, aliphatic, or polar residue, more particularly valine or threonine; residue corresponding to X31 is a cysteine, constrained, aromatic, non-polar, polar, or basic residue, more particularly tryptophan, cysteine, threonine, asparagine, lysine, histidine, phenylalanine, leucine, valine, or methionine; residue corresponding to X71 is a cysteine, basic, acidic, aromatic, non-polar, aliphatic or polar residue, particularly cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:116). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:116), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X28 is a non-polar, aliphatic, or polar residue, more particularly valine or threonine; residue corresponding to X31 is a cysteine, constrained, aromatic, non-polar, polar, or basic residue, more particularly tryptophan, cysteine, threonine, asparagine, lysine, histidine, phenylalanine, leucine, valine, or methionine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:124). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:124), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X28 is a non-polar, aliphatic, or polar residue, more particularly valine or threonine; residue corresponding to X31 is a cysteine, constrained, aromatic, non-polar, polar, or basic residue, more particularly tryptophan, cysteine, threonine, asparagine, lysine, histidine, phenylalanine, leucine, valine, or methionine; residue corresponding to X56 is a non-polar, aliphatic or polar residue, more particularly threonine, isoleucine, or leucine; residue corresponding to X71 is a cysteine, basic, acidic, aromatic, non-polar, aliphatic or polar residue, particularly cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:128). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:128), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X28 is a non-polar, aliphatic, or polar residue, more particularly valine or threonine; residue corresponding to X56 is a non-polar, aliphatic or polar residue, more particularly threonine, isoleucine, or leucine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; residue corresponding to X697 is a non-polar, aliphatic, or aromatic residue, more particularly leucine, phenylalanine, or glycine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:130). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:130), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X28 is a non-polar, aliphatic, or polar residue, more particularly valine or threonine; residue corresponding to X56 is a non-polar, aliphatic or polar residue, more particularly threonine, isoleucine, or leucine; residue corresponding to X71 is a cysteine, basic, acidic, aromatic, non-polar, aliphatic or polar residue, particularly cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:136). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:136), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X24 is an aromatic, non-polar or aliphatic residue, more particularly tyrosine or alanine; residue corresponding to X28 is a non-polar, aliphatic, or polar residue, more particularly valine or threonine; residue corresponding to X71 is a cysteine, basic, acidic, aromatic, non-polar, aliphatic or polar residue, particularly cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:138). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:138), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X28 is a non-polar, aliphatic, or polar residue, more particularly valine or threonine; residue corresponding to X31 is a cysteine, constrained, aromatic, non-polar, polar, or basic residue, more particularly tryptophan, cysteine, threonine, asparagine, lysine, histidine, phenylalanine, leucine, valine, or methionine; residue corresponding to X56 is a non-polar, aliphatic or polar residue, more particularly threonine, isoleucine, or leucine; residue corresponding to X71 is a cysteine, basic, acidic, aromatic, non-polar, aliphatic or polar residue, particularly cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X697 is a non-polar, aliphatic, or aromatic residue, more particularly leucine, phenylalanine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:140). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:140), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X28 is a non-polar, aliphatic, or polar residue, particularly a non-polar or aliphatic residue, more particularly valine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; residue corresponding to X697 is a non-polar, aliphatic, or aromatic residue, more particularly leucine, phenylalanine, or glycine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:146). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:146), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X28 is a non-polar, aliphatic, or polar residue, more particularly valine or threonine; residue corresponding to X56 is a non-polar, aliphatic or polar residue, more particularly threonine, isoleucine, or leucine; residue corresponding to X71 is a cysteine, basic, acidic, aromatic, non-polar, aliphatic or polar residue, particularly cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:144 or 152). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:144 or 152), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X28 is a non-polar, aliphatic, or polar residue, more particularly valine or threonine; residue corresponding to X31 is a cysteine, constrained, aromatic, non-polar, polar, or basic residue, more particularly tryptophan, cysteine, threonine, asparagine, lysine, histidine, phenylalanine, leucine, valine, or methionine; residue corresponding to X56 is a non-polar, aliphatic or polar residue, more particularly threonine, isoleucine, or leucine; residue corresponding to X71 is a cysteine, basic, acidic, aromatic, non-polar, aliphatic or polar residue, particularly cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:160). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference a chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:160), with the proviso that the PGA amino acid sequence has at least the preceding features.

In some embodiments, an improved PGA amino acid sequence based on the α-chain and β-chain of the sequence formula of SEQ ID NO:181, comprises an amino acid sequence having at least the following features: residue corresponding to X28 is a non-polar, aliphatic, or polar residue, more particularly valine or threonine; residue corresponding to X71 is a cysteine, basic, acidic, aromatic, non-polar, aliphatic or polar residue, particularly cysteine, basic, acidic, non-polar, aliphatic or polar residue, more particularly glycine, leucine, valine, cysteine, lysine, arginine, glutamic acid, or glutamine; residue corresponding to X74 is an acidic, non-polar, or aliphatic residue, particularly a non-polar or aliphatic residue, more particularly glycine; residue corresponding to X547 is a basic or polar residue, particularly a polar residue, more particularly glutamine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:162). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:162), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X28 is a non-polar, aliphatic, or polar residue, more particularly valine; residue corresponding to X56 is a non-polar, aliphatic or polar residue, more particularly threonine, isoleucine, or leucine; residue corresponding to X74 is an acidic or non-polar residue, particularly a non-polar residue, more particularly glycine; residue corresponding to X547 is a basic or polar residue, particularly a polar residue, more particularly glutamine; residue corresponding to X697 is a non-polar, aliphatic, or aromatic residue, more particularly leucine, tryptophan, or glycine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:176). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:176), with the proviso that the PGA amino acid sequence has at least the preceding features.

In some embodiments, an improved PGA comprising an amino acid sequence based on α-chain and β-chain of the sequence formula of SEQ ID NO:181, comprises an amino acid sequence having at least the following features: residue corresponding to X28 is a non-polar, aliphatic, or polar residue, more particularly valine; residue corresponding to X56 is a non-polar, aliphatic or polar residue, more particularly threonine, isoleucine, or leucine; residue corresponding to X74 is an acidic or non-polar residue, particularly a non-polar residue, more particularly glycine; residue corresponding to X547 is a basic or polar residue, particularly a polar residue, more particularly glutamine; and residue corresponding to X701 is a cysteine, aromatic, constrained, non-polar, or aliphatic residue, more particularly tryptophan, histidine, tyrosine, valine, leucine, methionine, or glycine. In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO:2 having the preceding features (e.g., SEQ ID NO:158 or 178). In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO:2 having the preceding features (e.g., SEQ ID NO:158 or 178), with the proviso that the PGA amino acid sequence has at least the preceding features.

In some embodiments, wherein the PGA is a single chain polypeptide, where the α and β chains are linked by a spacer or linker. The linker or spacer unit should be of sufficient length and structural properties to allow the β and α units to interact and form a functional PGA. In some embodiments, the spacer or linker peptides are 2, 3, 4, 5, 6, 7, 8, 9, 10, 11, 12, 13, 14, 15, 16, 18 or 20 or more amino acids in length. In particular, the spacer or linker length is about 4, 5 or 6 amino acids in length. The linker or spacer units can have sufficient flexibility and length to allow the connected β and α units to fold properly and form an active enzyme with the properties described herein.

In some embodiments, the linker or spacer comprises a peptide of small amino acids, such as glycine, alanine, serine, or threonine. In some embodiments, the linker or spacer comprises (Gly)n, where n can be from 2 to 20 or more. In some embodiments, the linker or spacer comprises (Ser)n or (Thr)n, where n can be from 2-20 or more. In some embodiments, the linker or spacer comprises a combination of Ser, Gly, and Ala residues, for instance (Gly-Ser)n, (Gly)n-(Ser)m, (Gly)n-(Ala)q, or (Gly)n-(Ser)m-(Ala)q, where n, m, and q are independently 1 to 7.

In some embodiments, the linker or spacer can comprise a peptide of the following structure:

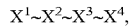

wherein

X¹ is a basic, acidic, polar, non-polar, aliphatic, or constrained residue;
X² is a constrained, acidic, non-polar or aliphatic residue;
X³ is a basic, acidic, polar, non-polar, aliphatic residue; and
X⁴ is a basic, acidic, polar, non-polar, aliphatic residue.

In some embodiments, the linker or spacer comprises a peptide having the following structure: X¹ is a polar residue; X² is a non-polar or aliphatic residue; X³ is an acidic residue; and X4 is a polar residue.

In some embodiments, the linker or spacer comprises a peptide selected from the following:

Gln~Glu~Gly~Met;

Gln~Leu~Asp~Gln;

Asp~Pro~Ala~Gly;

Arg~Gly~Ala~Gly;

Pro~Gly~Val~Gly;

Arg~Glu~Gly~Met;

Gly~Asp~Ala~Leu;

Gln~Gly~Ala~Gly;

Ala~Glu~Ser~Ser;

Gly~Ala~Arg~Asp; and

Gln~Leu~Ala~Gly.

In some embodiments, as will be apparent to the skilled artisan, spacer or linker polypeptides can be obtained by using a random peptide library of n amino acids in length to connect the β and α units, and screening for active PGA polypeptides. In some embodiments, a linker/spacer functional in a single chain PGA can be subjected to directed mutagenesis and screened for those resulting in other functional linkers, including those providing improved enzyme properties. Moreover, in the design of the linkers, the length and the composition can be varied to identify other functional spacer or linkers Table 2 below provides exemplary engineered PGA enzymes of the disclosure. The sequences are derived from the naturally occurring PGA of *K citrophila* of SEQ ID NO: 2 and are engineered as single chain polypeptides based on the B-L-A single chain structure of SEQ ID NO: 32. In Table 2 below, each row lists two SEQ ID NOs, where the odd number refers to the nucleotide sequence that encodes the amino acid sequence provided by the even number. The specific substitutions with respect to the single chain PGA reference sequence of SEQ ID NO: 32 are listed in the column "Residue Differences (from SEQ ID NO:32)." The number of residue differences as compared to the single chain SEQ ID NO: 32 are also listed.

Accordingly, in some embodiments, the engineered PGAs can comprise an α-chain and β-chain in the sequence corresponding to SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178.

In some embodiments, the engineered PGAs can comprise a single chain PGA having the sequence corresponding to SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178.

TABLE 2

| SEQ ID NO: (nt/aa) | Residue Differences (from SEQ ID NO: 32) | Number of Residue Differences (from SEQ ID NO: 32) |
|---|---|---|
| 1/2 | | NA |
| 3/4 | A28V; D74G; K547Q; | 3 |
| 5/6 | A28V; D74G; K547Q; F701W | 4 |
| 7/8 | F24Y; D74G; K547Q; | 3 |
| 9/10 | A28V; D74G; W431R; K547Q; | 4 |
| 11/12 | A28V; D74G; K547Q; F701L | 4 |
| 13/14 | A28V; D74G; K547Q; F701A | 4 |
| 15/16 | A28V; D74G; K547Q; F701Y | 4 |
| 17/18 | F24A; A28V; D74G; K547Q; | 4 |
| 19/20 | A28V; F71L; D74G; K547Q; | 4 |
| 21/22 | A28V; F71V; D74G; K547Q; | 4 |
| 23/24 | A28V; F71C; D74G; K547Q; | 4 |
| 25/26 | A28V; F71K; D74G; K547Q; | 4 |
| 27/28 | A28V; F71R; D74G; K547Q; | 4 |
| 29/30 | A28V; F71E; D74G; K547Q; | 4 |
| 31/32 | | 0 |
| 33/34 | A28V; D74G; K547Q; F701V | 4 |
| 35/36 | A28V; D74G; K547Q; F701H | 4 |
| 37/38 | A28V; D74G; K547Q; F701C | 4 |
| 39/40 | A28V; D74G; K547Q; F701I | 4 |
| 41/42 | A28V; D74G; K547Q; F701M | 4 |
| 43/44 | A28V; D74G; K547Q; F701G | 4 |
| 45/46 | A28V; D74G; K547Q; M697L | 4 |
| 47/48 | A28V; D74G; K547Q; D558Q; M697F | 4 |
| 49/50 | A28V; D74G; K547Q; D558Q; M697G | 4 |
| 51/52 | A28V; V56T; D74G; K547Q; D558Q | 4 |
| 53/54 | A28V; V56I; D74G; K547Q; D558Q | 4 |
| 55/56 | A28V; V56L; D74G; K547Q; D558Q | 4 |
| 57/58 | A28V; D74G; I177T; K547Q; D558Q; | 4 |
| 59/60 | A28V; D74G; K547Q; D558Q; | 3 |
| 61/62 | A28V; D74G; W154F; K547Q; D558Q; | 4 |
| 63/64 | A28V; D74G; W154F; K547Q; D558Q; L754P | 5 |
| 65/66 | Y31F; D74G; K547Q; D558Q; | 3 |
| 67/68 | Y31L; D74G; K547Q; D558Q; | 3 |
| 69/70 | Y31V; D74G; K547Q; D558Q; | 3 |
| 71/72 | Y31T; D74G; K547Q; D558Q; | 3 |
| 73/74 | Y31C; D74G; K547Q; D558Q; | 3 |
| 75/76 | Y31N; D74G; K547Q; D558Q; | 3 |

TABLE 2-continued

| SEQ ID NO: (nt/aa) | Residue Differences (from SEQ ID NO: 32) | Number of Residue Differences (from SEQ ID NO: 32) |
|---|---|---|
| 77/78 | Y31M; D74G; K547Q; D558Q; | 3 |
| 79/80 | Y31K; D74G; K547Q; D558Q; | 3 |
| 81/82 | A28V; F71C; K547Q; D558Q; | 3 |
| 83/84 | A28V; F71G; K547Q; D558Q; | 3 |
| 85/86 | A28V; F71Q; P164S; K547Q; D558Q; | 4 |
| 87/88 | A28V; F71G; K547Q; D558Q; | 3 |
| 89/90 | F24Y; F71C; D74G; K547Q; D558Q; F701W | 5 |
| 91/92 | F24Y; V56I; D74G; A308T; T379A; K547Q; D558Q; F701W | 7 |
| 93/94 | F24Y; D74G; D321N; K547Q; D558Q; F701H | 5 |
| 95/96 | F24Y; D74G; N457Y; K547Q; D558Q; F701W | 5 |
| 97/98 | F24Y; V56I; D74G; K547Q; D558Q; F701W | 5 |
| 99/100 | F24Y; Y27C; A28T; D74G; K547Q; D558Q; F701W; V729F | 7 |
| 101/102 | F24A; A28V; Y31W; V56I; D74G; K547Q; F701W | 7 |
| 103/104 | F24A; A28V; V56I; D74G; K547Q; F701W | 6 |
| 105/106 | F24A; A28V; Y31C; V56I; D74G; S386P; K547Q; F701Y | 8 |
| 107/108 | F24A; A28V; F71C; D74G; K547Q; F701W | 6 |
| 109/110 | F24A; A28V; P29S; V56L; D74G; T352S; N483S; K547Q; | 8 |
| 111/112 | F24A; A28V; D74G; L225V; K547Q; F701Y | 6 |
| 112/114 | F24A; A28V; Y31W; V56T; D74G; V264A; K547Q; F701W; S750G | 9 |
| 115/116 | F24A; A28V; Y31W; F71C; D74G; K547Q; F701W | 7 |
| 117/118 | F24A; A28V; D74G; Q340R; V391G; K547Q; | 6 |
| 119/120 | F24A; A28V; D74G; D484N; K547Q; F701W | 6 |
| 121/122 | F24A; A28V; V56T; D74G; K547Q; F701W | 6 |
| 123/124 | F24A; A28V; Y31W; D74G; K547Q; | 8 |
| 125/126 | F24A; A28V; V56I; D74G; W154F; I270V K547Q; M697L; | 8 |
| 127/128 | F24A; A28V; Y31H; V56I; F71C; D74G; K547Q; | 7 |
| 129/130 | F24A; A28V; V56I; D74G; K547Q; M697F; F701W | 7 |
| 131/132 | F24A; A28V; V56L; D74G; W240R; K547Q; F701W | 7 |
| 133/134 | F24A; A28V; Y31W; V56I; D74G; K547Q; F701Y | 7 |
| 135/136 | F24A; A28V; V56T; F71C; D74G; K547Q; | 6 |
| 137/138 | F24A; A28V; F71L; D74G; K547Q; | 5 |
| 139/140 | F24A; A28V; Y31W; V56I; D74G; K547Q; M697L | 7 |
| 141/142 | A28V; V56L; D74G; I77T; K547Q; F701W | 6 |
| 143/144 | A28V; V56T; F71G; D74G; K547Q; F701W | 6 |
| 145/146 | A28V; D74G; K547Q; M697L; F701Y; | 5 |
| 147/148 | W26C; A28V; D74G; K547Q; F701W | 5 |

TABLE 2-continued

| SEQ ID NO: (nt/aa) | Residue Differences (from SEQ ID NO: 32) | Number of Residue Differences (from SEQ ID NO: 32) |
|---|---|---|
| 149/150 | A28V; V56T; D74G; K547Q; W658R; F701W | 6 |
| 151/152 | A28V; V56T; F71G; D74G; K547Q; F701I | 6 |
| 153/154 | A28V; D74G; A410P; K547Q; M697F; F701W | 6 |
| 155/156 | A28V; V56L; D74G; K322R; K547Q; M697L; F701V | 7 |
| 157/158 | A28V; V56L; D74G; K547Q; F701H | 5 |
| 159/160 | A28V; Y31C; V56L; D74G; K547Q; F701H | 6 |
| 161/162 | A28V; F71G; D74G; K547Q; F701W | 5 |
| 163/164 | A28V; D74G; T129A; I511F; K547Q; F701W | 6 |
| 165/166 | A28V; D74G; D501N; K547Q; F701W | 5 |
| 167/168 | A28V; V56T; D74G; K547Q; F701W; L711Q; | 6 |
| 169/170 | A28V; D74G; I423T; K547Q; F701W | 5 |
| 171/172 | A28V; V56I; D74G; W154F; K547Q; F701W | 6 |
| 173/174 | A28V; V56L; D74G; W119R; K146E; K547Q; F701W | 7 |
| 175/176 | A28V; V56T; D74G; K547Q; D556Q P557L; A558D; G559Q; M697L; F701W | 6 |
| 177/178 | A28V; V56T; D74G; K547Q; F701W | 5 |

In some embodiments, the engineered PGA polypeptide can comprise an amino acid sequence that is at least 70%, 75%, 80%, 81%, 82%, 83%, 84%, 85%, 86%, 87%, 88%, 89%, 90%, 91%, 92%, 93%, 94%, 95%, 96%, 97%, 98%, or 99% identical to a reference amino acid sequence of any one of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178, and wherein the amino acids at the positions of residue differences indicated in Table 2 (above) are unchanged and the polypeptide has improved activity with respect to the naturally occurring PGA of K. citrophila. Accordingly, in some embodiments, the engineered PGAs are capable of converting 6-nitro-3-(phenylacetamide)benzoic acid (NIPAB) to phenylacetic acid and 5-amino-2-nitro-benzoic acid with improved rate relative to the naturally occurring PGA of K. citrophila and comprise an amino acid sequence at least about 70% identical to SEQ ID NO: 32 and further comprise the combination of residue differences of any one of SEQ ID NO: 6, 8, 10, 12, 14, 16, 18, 20, 22, 24, 26, 28, 30, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178.

In some embodiments, the PGA polypeptides of the disclosure have an improved property (e.g., increased enzymatic activity, solvent stability, thermal stability, stereospecificity, etc.) and an α chain amino acid sequence and a β chain amino acid sequence that is at least about 85%, 86%, 87%, 88%, 89%, 90%, 91%, 92%, 93%, 94%, 95%, 96%, 97%, 98%, 99% or more identical to a reference α chain and β chain sequences in the references sequences of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178. In some embodiments, these PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences. In some embodiments, the differences comprise conservative mutations.

In some embodiments, an improved PGA polypeptide comprises an α chain amino acid sequence and/or a β chain amino acid sequence that are independently at least about 85%, 86%, 87%, 88%, 89%, 90%, 91%, 92%, 93%, 94%, 95%, 96%, 97%, 98%, or 99% identical to a reference α chain sequence and β chain sequence based on SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178, with the proviso that the PGA amino acid sequence comprises any one of the set of mutations contained in any one of the polypeptide sequences listed in Table 2 in the α-chain and/or β-chain sequences. As described herein, the PGA polypeptides can comprise separate α and β chains, or comprise a single chain polypeptide, as exemplified by the sequences of Table 2. In some embodiments, these PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions in each of the α chain and β chain as compared to the reference α and β chain sequences. In some embodiments, the number of differences can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residues in each of the α and β chains. In some embodiments, the differences comprise conservative mutations.

In some embodiments, the PGA polypeptides are capable of mediating conversion of 6-nitro-3-(phenylacetamide)benzoic acid to phenylacetic acid and 5-amino-2-nitro-benzoic acid at a rate higher than the naturally occurring PGA enzyme of *K. citrophila* (e.g., the mature enzyme based on SEQ ID NO:2), and comprises an amino acid sequence corresponding to the sequence of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 82, 84, 86, 88, 90, 92, 94, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 164, 168, 170, or 172.

In some embodiments, the PGA polypeptides are capable of mediating conversion of 6-nitro-3-(phenylacetamide)benzoic acid to phenylacetic acid and 5-amino-2-nitro-benzoic acid at a rate that is at least 1.5 times greater than the naturally occurring PGA enzyme of *K. citrophila* (e.g., the mature enzyme based on SEQ ID NO:2), and comprises an amino acid sequence corresponding to the sequence of SEQ ID NO: 4, 6, 8, 20, 24, 26, 30, 32, 46, 48, 52, 54, 56, 58, 60, 62, 64, 72, 82, 84, 86, 88, 90, 96, 98, 100, 148, and 172.

In some embodiments, the PGA polypeptides are capable of mediating conversion of 6-nitro-3-(phenylacetamide)benzoic acid to phenylacetic acid and 5-amino-2-nitro-benzoic acid at a rate that is at least 4 times greater than the naturally occurring PGA enzyme of *K. citrophila* (e.g., the mature enzyme based on SEQ ID NO:2), and comprises an amino acid sequence corresponding to the sequence of SEQ ID NO: 4, 8, 20, 24, 26, 30, 32, 46, 52, 54, 56, 58, 60, 62, 64, 82, 84, 86, 96, 98, 148, and 172.

In some embodiments, the PGA polypeptides are capable of converting greater than 15% of methyl-4-methoxyphenylacetate ester to the corresponding product, wherein the PGA polypeptide comprises a sequence corresponding to the sequence of SEQ ID NO: 6, 16, 22, 24, 46, 52, 54, 60, 62, 64, 144, 146, 148, 150, 162, 166, 168, 170, 172, 176, or 178.

In some embodiments, the PGA polypeptides are capable of converting greater than 50% of methyl-4-methoxyphenylacetate ester to the corresponding product, wherein the PGA polypeptide comprises a sequence corresponding to the sequence of SEQ ID NO: 16, 62, 168, 170, 172, 176, or 178.

In some embodiments, the PGA polypeptides are capable of converting greater than 30% of methyl-4-hydroxy phenylacetate ester substrate to the corresponding cleaved products, wherein the PGA polypeptide comprises a sequence corresponding to the sequence of SEQ ID NO: 6, 8, 10, 16, 20, 22, 24, 30, 34, 36, 38, 40, 42, 44, 48, 50, 52, 54, 56, 58, 60, 62, 64, 78, 80, 82, 84, 86, 88, 90, 92, 98, 100, 132, 134, 136, 142, 144, 146, 148, 150, 154, 162, 166, 168, 170, 172, 176, or 178.

In some embodiments, the PGA polypeptides are capable of converting greater than 60% of methyl-4-hydroxy phenylacetate ester to the corresponding cleaved products, wherein the PGA polypeptide comprises a sequence corresponding to the sequence of SEQ ID NO: 8, 60, 62, 90, 92, 142, 144, 154, 162, 168, 170, 172, 176, or 178.

In some embodiments, the PGA polypeptides are capable of converting greater than 20% of methyl-4-chloro phenylacetate ester to the corresponding cleaved products, wherein the PGA polypeptide comprises a sequence corresponding to the sequence of SEQ ID NO: 8, 16, 20, 22, 24, 30, 32, 34, 36, 46, 52, 54, 74, 76, 78, 88, 90, 92, 96, 98, 126, 128, 130, 132, 134, 136, 142, 144, 146, 148, 150, 162, 168, 170, 172, 176, or 178.

In some embodiments, the PGA polypeptides are capable of converting greater than 40% of methyl 4-chloro-phenylacetate ester to the corresponding cleaved products, wherein the PGA polypeptide comprises a sequence corresponding to the sequence of SEQ ID NO: 16, 32, 92, 96, 98, 150, 162, 168, 170, 172, 176, or 178.

In some embodiments, the PGA polypeptides are capable of converting greater than 10% of methyl phenylacetate ester, wherein the PGA polypeptide comprises a sequence corresponding to the sequence of SEQ ID NO: 4, 6, 8, 10, 12, 16, 20, 22, 24, 30, 32, 34, 36, 38, 40, 42, 44, 46, 48, 52, 54, 56, 58, 60, 62, 64, 68, 70, 72, 74, 76, 78, 80, 88, 92, 94, 96, 98, 100, 102, 104, 106, 108, 110, 112, 114, 116, 118, 120, 122, 124, 126, 128, 130, 132, 138, 140, 142, 144, 146, 148, 150, 152, 156, 160, 162, 164, 166, 168, 170, 172, 176, or 178.

In some embodiments, the PGA polypeptides are capable of converting greater than 20% of methyl phenylacetate ester, wherein the PGA polypeptide comprises a sequence corresponding to the sequence of SEQ ID NO: 6, 8, 16, 32, 46, 56, 58, 60, 92, 120, 148, 150, 152, 168, 170, 172, 176, or 178.

In some embodiments, the PGA polypeptides are capable of converting methyl α-methyl-4-chlorophenylacetate ester at a rate greater than the naturally occurring PGA of *K. citrophila*, wherein the PGA polypeptide comprises a sequence corresponding to the sequence of SEQ ID NO: 4, 6, 16, 20, 22, 24, 30, 32, 34, 52, 54, 60, 66, 68, 70, 74, 76, 78, 84, 86, 128, 130, 132, 134, 136, 146, 148, 150, 162, 166, 168, 170, 172, or 178.

In some embodiments, the PGA polypeptides are capable of converting 3% or more of methyl α-methyl-4-chlorophenylacetate ester, wherein the PGA polypeptide comprises a sequence corresponding to the sequence of SEQ ID NO: 6, 16, 32, 54, 128, 148, 150, 170, or 178.

In some embodiments, the PGA polypeptides are capable of converting 15% or more of methyl α-hydroxy phenylacetate ester, wherein the PGA polypeptide comprises a sequence corresponding to the sequence of SEQ ID NO: 4, 6, 10, 16, 18, 20, 22, 24, 30, 32, 34, 36, 38, 40, 42, 44, 48, 50, 54, 56, 58, 60, 62, 64, 72, 74, 76, 78, 80, 82, 84, 86, 88, 92, 96, 98, 100, 102, 132, 142, 144, 146, 150, 156, 158, 160, 162, 164, 166, 168, 170, 172, 174, 176, or 178.

In some embodiments, the PGA polypeptides are capable of converting greater than 30% of methyl-α-hydroxy phenylacetate ester, wherein the PGA polypeptide comprises an amino acid sequence corresponding to the sequence of SEQ ID NO: 16, 32, 84, 88, 142, 162, 166, 168, 170, 172, 176, or 178.

In some embodiments, the PGA polypeptides are capable of converting methyl α-methoxy phenylacetate ester at a rate greater than the naturally occurring PGA of *K. citrophila*, wherein the PGA polypeptide comprises a sequence corresponding to the sequence of SEQ ID NO: 12, 32, 40, 42, 54, 56, 58, 62, 64, 68, 78, 80, 152, 156, or 160.

In some embodiments, the PGA polypeptides are capable of converting 10% or more of methyl-α-methoxy phenylacetate ester, wherein the PGA polypeptide comprises a sequence corresponding to the sequence of SEQ ID NO: 12, 68, 74, 80, 152, or 158.

In some embodiments, the PGA polypeptides have S stereospecificity for methyl α-hydroxy phenylacetate ester, and forming an enantiomeric excess of 10% or more of S-α-hydroxy phenylacetic acid, wherein the PGA polypeptide comprises an amino acid sequence corresponding to the sequence of SEQ ID NO: 4, 10, 16, 30, 32, 84, 86, 88, 92, 96, 98, 100, 134, 136, 142, 144, 146, 148, 150, 154, 162, 164, 166, 168, 170, 172, 174, or 176.

In some embodiments, the PGA polypeptides have S stereospecificity for methyl α-hydroxy phenylacetate ester, and capable forming an enantiomeric excess of greater than 30% of S-α-hydroxy phenylacetic acid, wherein the PGA polypeptide comprises an amino acid sequence corresponding to the sequence of SEQ ID NO: 16, 100, 142, 144, 162, 164, 166, 168, 170, 172, or 176.

In some embodiments, the PGA polypeptides have R stereospecificity for methyl α-hydroxy phenylacetate ester, and capable of forming an enantiomeric excess of R-α-hydroxy phenylacetic acid, wherein the PGA polypeptide comprises an amino acid sequence corresponding to the sequence of SEQ ID NO: 6, 8, 12, 14, 18, 20, 22, 34, 36, 38, 40, 42, 44, 48, 50, 52, 54, 56, 58, 60, 62, 64, 66, 68, 70, 72, 74, 76, 78, 80, 94, 102, 106, 152, 156, 158, or 160.

In some embodiments, the PGA polypeptides have S stereospecificity for methyl α-methoxy phenylacetate ester, and is capable forming an enantiomeric excess of S-α-methoxy phenylacetic acid, wherein the PGA polypeptide comprises an amino acid sequence corresponding to the sequence of SEQ ID NO: 12, 32, 40, 54, 56, 58, 62, 64, 152, 156, or 160.

In some embodiments, the PGA polypeptides are capable of converting 20% or more of 1-phenylethyl 2-phenylacetate, wherein the PGA polypeptide comprises an amino acid sequence corresponding to the sequence of SEQ ID NO: 4, 8, 10, 16, 20, 22, 24, 32, 34, 38, 40, 42, 44, 46, 48, 50, 52, 54, 56, 58, 60, 62, 64, 70, 72, 74, 82, 84, 86, or 88.

In some embodiments, the PGA polypeptides have R stereospecificity for R-1-phenylethyl 2-phenylacetate, and is capable of forming an enantiomeric excess of 20% or more of R-phenylethanol, wherein the PGA polypeptide comprises an amino acid sequence corresponding to the sequence of SEQ ID NO: 4, 6, 8, 10, 12, 14, 20, 22, 24, 26, 28, 30, 32, 34, 36, 38, 40, 42, 44, 46, 48, 50, 52, 54, 56, 58, 60, 62, 64, 66, 68, 70, 72, 74, 76, 80, 82, 84, 86, 88, 94 or 160.

In some embodiments, the PGA polypeptides have stereospecificity for R-1-phenylethyl 2-phenylacetate, and is capable of forming an enantiomeric excess of greater than 50% of R-1-phenylethanol, wherein the PGA polypeptide comprises an amino acid sequence corresponding to the sequence of SEQ ID NO: 4, 8, 10, 12, 14, 20, 26, 28, 30, 32, 34, 36, 38, 40, 42, 44, 46, 48, 50, 52, 54, 56, 58, 60, 62, 64, 66, 76, 84, 86, 88, 94, or 160.

In some embodiments, the PGA polypeptides are capable of converting 15% or more of 1-phenylethyl 2-(4-chlorophenyl)acetate, wherein the PGA polypeptide comprises an amino acid sequence corresponding to the sequence of SEQ ID NO: 0.4, 6, 10, 16, 20, 22, 24, 30, 32, 34, 36, 38, 44, 46, 48, 54, 56, 58, 60, 62, 64, 68, 70, 72, 82, 84, 86, or 88.

In some embodiments, the PGA polypeptides have stereospecificity for R 1-phenylethyl 2-(4-chloro-phenyl)acetate, and is capable of forming an enantiomeric excess of 20% or more of R-1-phenylethanol, wherein the PGA polypeptide comprises an amino acid sequence corresponding to the sequence of SEQ ID NO: 0.4, 6, 8, 10, 12, 14, 20, 22, 24, 26, 28, 30, 32, 34, 36, 38, 44, 46, 48, 50, 52, 54, 56, 58, 60, 62, 64, 68, 70, 72, 74, 76, 82, 84, 86, or 88.

In some embodiments, the PGA polypeptides are capable of converting 10% or more of 1-phenylpropyl 2-phenylacetate, wherein the PGA polypeptide comprises an amino acid sequence corresponding to the sequence of SEQ ID NO: 4, 8, 10, 20, 22, 24, 30, 32, 34, 38, 40, 42, 44, 46, 48, 50, 52, 54, 56, 58, 60, 62, 64, 82, 84, 86, 88, 152, or 156.

In some embodiments, the PGA polypeptides have stereospecificity for R 1-phenylpropyl 2-phenylacetate, and is capable of forming an enantiomeric excess of greater than 10% of R-1-phenylpropanol, wherein the PGA polypeptide comprises an amino acid sequence corresponding to the sequence of SEQ ID NO: 10, 32, 34, 40, 42, 48, 50, 52, 54, 56, 60, 62, 64, or 84.

In some embodiments, the PGA polypeptides have a synthesis/hydrolysis (S/H) ratio that is improved over the naturally occurring PGA of K. citrophila. In some embodiments, the PGA polypeptide has a S/H ratio of at least 1.2 of the naturally occurring PGA of K. citrophila, where the PGA polypeptide comprises an amino acid sequence corresponding to the sequence of SEQ ID NO: 22, 24, 26, 82, or 84.

In some embodiments, the improved engineered PGA enzymes comprise deletions of the naturally occurring PGA polypeptides or deletions of other engineered PGA polypeptides. In some embodiments, each of the improved engineered PGA enzymes described herein can comprise deletions of the polypeptides described herein. Thus, for each and every embodiment of the PGA polypeptides of the disclosure, the deletions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 10% of the total number of amino acids, up to 20% of the total number of amino acids, or up to 30% of the total number of amino acids of the PGA polypeptides, as long as the functional activity of the PGA polypeptide is maintained. The deletions can be in the α-chain sequence, the β-chain sequence, or the α- and β-chain sequences. In some embodiments, the deletions can comprise, 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 amino acid residues. In some embodiments, the number of deletions can be 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 amino acids.

In some embodiments, the PGA polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, 1-60, 1-65, 1-70, 1-75, or 1-80 residue differences at other amino acid residue positions as compared to the reference α- and β-chain sequences of SEQ ID NO: 2 or 32. In some embodiments, the PGA polypeptides can have additionally 1, 2, 3, 4, 5, 6, 7, 8, 9, 10, 11, 12, 14, 15, 16, 18, 20, 22, 24, 26, 30, 35, 40, 45, 50, 55, 60, 65, 70, 75, or 80 residue differences at other amino acid residue positions in the reference α chain and β chain sequences. In some embodiments, the PGA polypeptide comprises an amino acid sequence that is at least 85%, 86%, 87%, 88%, 89%, 90%, 91%, 92%, 93%, 94%, 95%, 96%, 97%, 98%, 99% or more identical to a reference α and β chain sequences based on SEQ ID NO: 2 or 32 having the preceding features, with the proviso that the PGA amino acid sequence has at least the preceding features.

The polypeptides described herein are not restricted to the genetically encoded amino acids. In addition to the genetically encoded amino acids, the polypeptides described herein may be comprised, either in whole or in part, of naturally-occurring and/or synthetic non-encoded amino acids. Certain commonly encountered non-encoded amino acids of which the polypeptides described herein may be comprised include, but are not limited to: the D-stereoisomers of the genetically-encoded amino acids; 2,3-diaminopropionic acid (Dpr); α-aminoisobutyric acid (Aib); ε-aminohexanoic acid (Aha); 6-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (PH); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutanic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aOly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (see, e.g., the various amino acids provided in Fasman, 1989, *CRC Practical Handbook of Biochemistry and Molecular Biology*, CRC Press, Boca Raton, Fla., at pp. 3-70 and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys (methylbenzyl), Cys (nitropyridinesulfenyl), Glu(δ-benzylester), Gln(xanthyl), Asn(N-δ-xanthyl), His(bom), His(benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

As described above the various modifications introduced into the naturally occurring polypeptide to generate an engineered PGA enzyme can be targeted to a specific property of the enzyme.

In some embodiments, the engineered PGA polypeptides of the disclosure can be suspended in solution, or be present a lyophilized or in powder form, such as acetone powder. In some embodiments, the PGA polypeptides of the disclosure can be present on a substrate. The substrate can be a solid phase, surface, and/or membrane. A solid support can be composed of organic polymers such as polystyrene, polyethylene, polypropylene, polyfluoroethylene, polyethyleneoxy, polyacrylamide, polysaccharides (e.g., chitosan, agarose) as well as co-polymers and grafts thereof. A solid support can also be inorganic, such as glass, silica, controlled pore glass (CPG), reverse phase silica or metal, such as gold or platinum. The configuration of the substrate can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location. A plurality of supports can be configured on an array at various locations, addressable for robotic delivery of reagents, or by detection methods and/or instruments. Various substrates for PGAs are described in Huang et al., 2008, *Macromol Biosci*. Jun. 11; 8(6):508-15; Wang et al., 2008, *Bioprocess Biosyst Eng*. 509-17; and Kheirolomoom et al., *J. Biosci. Bioeng*. 93:125-129; references incorporated herein by reference.

In some embodiments, specifically excluded from the engineered PGA polypeptides of the disclosure are the following PGA polypeptides and their associated polypeptide and polynucleotide sequences: (1) M168A mutated *K citrophila* PGA described in Martin et al., 1990, *Biochim Biophys Acta*. 1037 (2):133-9; (2) Lys374 and His481 mutated *K. citrophila* PGA described in Prieto et al., 1990, *Appl Microbiol Biotechnol*. 33(5):553-9; (3) F360V mutated *K. citrophila* PGA described in Roa et al., 1994, *Biochem J*. 303:869-75); (4) *K citrophila* sequences disclosed in U.S. Pat. No. 5,457,032, U.S. Pat. No. 5,891,703, and U.S. Pat. No. 6,403,356; and (5) *K citrophila* and *E. coli* PGA polypeptides disclosed in Zhou et al., 2003, *Sheng Wu Hua Xue Yu Sheng Wu Wu Li Xue Bao* (Shanghai) 35(6):573-9.

In some embodiments, specifically excluded from the engineered PGA enzymes of the disclosure are the following PGA enzymes and their associated polypeptide and polynucleotide sequences: (1) F701 mutated *E. coli* PGA described in Alkema et al., 2000, *Protein Eng*. 12:857-863; (2) F57Y, F701, and F24 mutated *E. coli*. PGAs described in Alkema et al., 2002, *Eur. J. Biochem* 269:2093-2100; (3) R700 and R263 mutated *E. coli*. PGA described in Alkema et al., 2002, *Biochem J*. 365:303-309; (4) F71 mutated *E. coli*. PGA described in Morillas et al., 2003, Biochem. J. 371:143-150; (5) R700 and 8263 mutated *E. coli*. PGA described in Guncheva et al., 2004, *Eur. J. Biochem.* 271:2272-2279; (6) V56, F701, T32, I177, P49, W154, F24 mutated *E. coli*. PGAs described in Oh et al., 2004, *Biochem. Biophys Res. Comm.* 319:486-492; (7) L100, A84, V356, T150N, N348, A305, V400, b311, A635, and Y580 mutated *E. coli*. PGA described in Polizzi et al., 2006, *Biotechnol. J.* 1:531-536; (8) F701 and R700 mutated *E. coli*. PGA described in 2008, *Biotechnol. J.* 133:18-27; (9) 51, N241, Q23, and A69 mutated *E. coli*. PGAs described in Done et al., 1998, *J. Mol. Biol.* 284:463-475; (10) V56, F146, T32, I177, P49, W154, F24, M697, and F57 mutated *E. coli* PGAs described in Alkema et al., 2000, *Protein Eng.* 12:857-863. All references are incorporated herein by reference.

6.3. Polynucleotide Encoding the PGA Polypeptides

In another aspect, the present disclosure provides polynucleotides encoding the engineered PGA polypeptides. The polynucleotides may be operatively linked to one or more heterologous regulatory sequences that control gene expression to create a recombinant polynucleotide capable of expressing the polypeptide. Expression constructs containing a heterologous polynucleotide encoding the engineered PGA polypeptides can be introduced into appropriate host cells to express the corresponding PGA polypeptide.

Because of the knowledge of the codons corresponding to the various amino acids, availability of a protein sequence provides a description of all the polynucleotides capable of encoding the subject. The degeneracy of the genetic code, where the same amino acids are encoded by alternative or synonymous codons allows an extremely large number of nucleic acids to be made, all of which encode the improved PGA enzymes disclosed herein. Thus, having identified a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made by selecting combinations based on the possible codon choices, and all such variations are to be considered specifically disclosed for any polypeptide disclosed herein, including the amino acid sequences presented in Table 2.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells.

In certain embodiments, all codons need not be replaced to optimize the codon usage of the PGA polypeptides since the natural sequence will comprise preferred codons and because use of preferred codons may not be required for all amino acid residues. Consequently, codon optimized polynucleotides encoding the PGA enzymes may contain preferred codons at about 40%, 50%, 60%, 70%, 80%, or greater than 90% of codon positions of the full length coding region.

In some embodiments, the polynucleotide comprises a nucleotide sequence encoding a PGA polypeptide with an amino acid sequence that has at least about 85%, 86%, 87%, 88%, 89%, 90%, 91%, 92%, 93%, 94%, 95%, 96%, 97%, 98%, or 99% or more sequence identity to α-chain and/or β-chain any of the reference engineered PGA polypeptides described herein. Accordingly, in some embodiments, the polynucleotide encodes an amino acid sequence that is at least about 85%, 86%, 87%, 88%, 89%, 90%, 91%, 92%, 93%, 94%, 95%, 96%, 97%, 98%, 99% or more identical to a reference α- and β-chain sequences based on SEQ ID NO: 130. In some embodiments, the polynucleotide encodes an α- and/or β-chain amino acid sequence of SEQ ID NO: 4, 6, 8, 10, 12, 14, 16, 18, 20, 22, 24, 26, 28, 30, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178.

In some embodiments, the polynucleotide comprises a nucleotide sequence encoding a PGA polypeptide with an amino acid sequence that has at least about 85%, 86%, 87%, 88%, 89%, 90%, 91%, 92%, 93%, 94%, 95%, 96%, 97%, 98%, or 99% or more sequence identity to α-chain and/or β-chain any of the reference engineered PGA polypeptides described herein. Accordingly, in some embodiments, the polynucleotide encodes an amino acid sequence that is at least about 85%, 86%, 87%, 88%, 89%, 90%, 91%, 92%, 93%, 94%, 95%, 96%, 97%, 98%, 99% or more identical to SEQ ID NO: 4, 6, 8, 10, 12, 14, 16, 18, 20, 22, 24, 26, 28, 30, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178.

In some embodiments, the polynucleotides encoding the α- and β-chain of the PGA polypeptides are selected from SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, or 177. In some embodiments, the polynucleotides are capable of hybridizing under highly stringent conditions to a polynucleotide comprising SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, or 177, where the highly stringently hybridizing polynucleotides encode a PGA polypeptide having improved activity as compared to the naturally occurring PGA enzyme of *K. citrophila*.

In some embodiments, the polynucleotides encode the polypeptides described herein but have about 80% or more sequence identity, about 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered PGA. In some embodiments, the reference polynucleotide is selected from SEQ ID NO: 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, or 177.

An isolated polynucleotide encoding an improved PGA polypeptide may be manipulated in a variety of ways to provide for expression of the polypeptide. Manipulation of the isolated polynucleotide prior to its insertion into a vector may be desirable or necessary depending on the expression vector. The techniques for modifying polynucleotides and nucleic acid sequences utilizing recombinant DNA methods are well known in the art. Guidance is provided in Sambrook et al., 2001, *Molecular Cloning: A Laboratory Manual*, 3rd Ed., Cold Spring Harbor Laboratory Press; and *Current Protocols in Molecular Biology*, Ausubel. F. ed., Greene Pub. Associates, 1998, updates to 2006.

For bacterial host cells, suitable promoters for directing transcription of the nucleic acid constructs of the present disclosure, include the promoters obtained from the *E. coli* lac operon, *E. coli* trp operon, bacteriophage λ, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (VIIIa-Kamaroff et al., 1978, *Proc. Natl. Acad. Sci. USA* 75: 3727-3731), as well as the tac promoter (DeBoer et al., 1983, *Proc. Natl. Acad. Sci. USA* 80: 21-25).

For filamentous fungal host cells, suitable promoters for directing the transcription of the nucleic acid constructs of the present disclosure include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* those phosphate isomerase), and mutant, truncated, and hybrid promoters thereof.

In a yeast host, useful promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are described by Romanos et al., 1992, *Yeast* 8:423-488.

The control sequence may also be a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice may be used in the present invention.

For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease.

Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra.

The control sequence may also be a suitable leader sequence, a nontranslated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells can be from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are described by Guo and Sherman, 1995, *Mol Cell Bio* 15:5983-5990.

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used in the present invention.

Effective signal peptide coding regions for bacterial host cells are the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are described by Simonen and Palva, 1993, *Microbiol Rev* 57: 109-137.

Effective signal peptide coding regions for filamentous fungal host cells can be the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase.

Useful signal peptides for yeast host cells can be from the genes for *Saccharomyces cerevisiae* alpha-factor and *Saccharomyces cerevisiae* invertase. Other useful signal peptide coding regions are described by Romanos et al., 1992, supra.

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active PGA polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences, which allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and trp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter.

Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the PGA polypeptide of the present invention would be operably linked with the regulatory sequence.

Thus, in another embodiment, the present disclosure is also directed to a recombinant expression vector comprising a polynucleotide encoding an engineered PGA polypeptide or a variant thereof, and one or more expression regulating regions such as a promoter and a terminator, a replication origin, etc., depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the polypeptide at such sites. Alternatively, the nucleic acid sequence of the present disclosure may be expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), which can be conveniently subjected to recombinant DNA procedures and can bring about the expression of the polynucleotide sequence. The choice of the vector will typically depend on the compatibility of the vector with the host cell into which the vector is to be introduced. The vectors may be linear or closed circular plasmids.

The expression vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The expression vector of the present invention preferably contains one or more selectable markers, which permit easy selection of transformed cells. A selectable marker is a gene the product of which provides for biocide or viral resistance, resistance to heavy metals, prototrophy to auxotrophs, and the like. Examples of bacterial selectable markers are the dal genes from *Bacillus subtilis* or *Bacillus licheniformis*, or markers, which confer antibiotic resistance such as ampicillin, kanamycin, chloramphenicol (Example 1) or tetracycline resistance. Suitable markers for yeast host cells are ADE2, HIS3, LEU2, LYS2, MET3, TRP1, and URA3.

Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Embodiments for use in an *Aspergillus* cell include the amdS and pyrG genes of *Aspergillus nidulans* or *Aspergillus oryzae* and the bar gene of *Streptomyces hygroscopicus*.

The expression vectors of the present invention preferably contain an element(s) that permits integration of the vector into the host cell's genome or autonomous replication of the vector in the cell independent of the genome. For integration into the host cell genome, the vector may rely on the nucleic acid sequence encoding the polypeptide or any other element of the vector for integration of the vector into the genome by homologous or nonhomologous recombination.

Alternatively, the expression vector may contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements should preferably contain a sufficient number of nucleic acids, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A on or the origins of replication of plasmids pBR322, pUC19, pACYC177 (which plasmid has the P15A ori), or pACYC184 permitting replication in *E. coli*, and pUB110, pE194, pTA1060, or pAMβ1 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it's functioning temperature-sensitive in the host cell (see, e.g., Ehrlich, 1978, *Proc Natl Acad. Sci. USA* 75:1433).

More than one copy of a nucleic acid sequence of the present invention may be inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many of the expression vectors for use in the present invention are commercially available. Suitable commercial expression vectors include p3xFLAGTM™ expression vectors from Sigma-Aldrich Chemicals, St. Louis Mo., which includes a CMV promoter and hGH polyadenylation site for expression in mammalian host cells and a pBR322 origin of replication and ampicillin resistance markers for amplification in *E. coli*. Other suitable expression vectors are pBluescriptII SK(−) and pBK-CMV, which are commercially available from Stratagene, LaJolla Calif., and plasmids which are derived from pBR322 (Gibco BRL), pUC (Gibco BRL), pREP4, pCEP4 (Invitrogen) or pPoly (Lathe et al., 1987, *Gene* 57:193-201).

6.4. Host Cells for Expression of PGA Polypeptides

In another aspect, the present disclosure provides a host cell comprising a polynucleotide encoding an improved PGA polypeptide of the present disclosure, the polynucleotide being operatively linked to one or more control sequences for expression of the PGA enzyme in the host cell. Host cells for use in expressing the PGA polypeptides encoded by the expression vectors of the present invention are well known in the art and include but are not limited to, bacterial cells, such as *E. coli, Bacillus megatarium, Lactobacillus kefir, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Appropriate culture mediums and growth conditions for the above-described host cells are well known in the art.

Polynucleotides for expression of the PGA may be introduced into cells by various methods known in the art. Techniques include among others, electroporation, biolistic particle bombardment, liposome mediated transfection, calcium chloride transfection, and protoplast fusion. Various methods for introducing polynucleotides into cells will be apparent to the skilled artisan.

An exemplary host cell is *Escherichia coli* W3110. The expression vector was created by operatively linking a polynucleotide encoding an improved PGA into the plasmid pCK110900 operatively linked to the lac promoter under control of the lad repressor. The expression vector also contained the P15a origin of replication and the chloramphenicol resistance gene. Cells containing the subject polynucleotide in *Escherichia coli* W3110 were isolated by subjecting the cells to chloramphenicol selection.

6.5. Methods of Generating Engineered PGA Polypeptides

In some embodiments, to make the improved PGA polynucleotides and polypeptides of the present disclosure, the naturally-occurring PGA enzyme that catalyzes the reduction reaction is obtained (or derived) from *K citrophila*. In some embodiments, the parent polynucleotide sequence is codon optimized to enhance expression of the PGA in a specified host cell. As an illustration, the parental polynucleotide sequence encoding the wild-type PGA polypeptide of *K citrophila* was constructed from oligonucleotides prepared based upon the known polypeptide sequence of *K citrophila* PGA sequence available in Genbank database. A single chain PGA of was constructed, with codons optimized for expression in *E. coli*, where the linker or spacer between the α and β chain was Asp~Pro~Ala~Gly. Clones expressing the PGA in *E. coli* were identified and the genes sequenced to confirm their identity. The construct was then utilized as the starting point for most experiments and library construction of engineered PGAs evolved from the *K citrophila* PGA.

The engineered PGAs can be obtained by subjecting the polynucleotide encoding the naturally occurring PGA to mutagenesis and/or directed evolution methods, as discussed above. An exemplary directed evolution technique is mutagenesis and/or DNA shuffling as described in Stemmer, 1994, *Proc Natl Acad Sci USA* 91:10747-10751; WO 95/22625; WO 97/0078; WO 97/35966; WO 98/27230; WO 00/42651; WO 01/75767 and U.S. Pat. No. 6,537,746. Other directed evolution procedures that can be used include, among others, staggered extension process (StEP), in vitro recombination (Zhao et al., 1998, *Nat. Biotechnol.* 16:258-261), mutagenic PCR (Caldwell et al., 1994, *PCR Methods Appl.* 3:S136-S140), and cassette mutagenesis (Black et al., 1996, *Proc Natl Acad Sci USA* 93:3525-3529).

The clones obtained following mutagenesis treatment are screened for engineered PGAs having a desired improved enzyme property. Measuring enzyme activity from the expression libraries can be performed using the standard biochemistry technique of monitoring the rate of product formation, for example hydrolysis of NIPAB to form the chromogenic product of 5-amino-2-nitro-benzoic acid. (For example, see Example 3) The rate of 5-amino-2-nitro-benzoic acid formation as measured by the increase in absorbance or fluorescence per unit time indicates the relative (enzymatic) activity of the PGA polypeptide in a fixed amount of the lysate (or a lyophilized powder made therefrom). Where the improved enzyme property desired is thermal stability, enzyme activity may be measured after subjecting the enzyme preparations to a defined temperature and measuring the amount of enzyme activity remaining after heat treatments. Clones containing a polynucleotide encoding a PGA are then isolated, sequenced to identify the nucleotide sequence changes (if any), and used to express the enzyme in a host cell.

Where the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides of the invention can be prepared by chemical synthesis using, e.g., the classical phosphoramidite method described by Beaucage et al., 1981, *Tet Lett* 22:1859-69, or the method described by Matthes et al., 1984, *EMBO J.* 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors. In addition, essentially any nucleic acid can be obtained from any of a variety of commercial sources, such as The Midland Certified Reagent Company, Midland, Tex., The Great American Gene Company, Ramona, Calif., ExpressGen Inc. Chicago, Ill., Operon Technologies Inc., Alameda, Calif., and many others.

Engineered PGA enzymes expressed in a host cell can be recovered from the cells and or the culture medium using any one or more of the well known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available under the trade name Celytic B™ from Sigma-Aldrich of St. Louis Mo.

Chromatographic techniques for isolation of the PGA polypeptide include, among others, reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., and will be apparent to those having skill in the art.

In some embodiments, affinity techniques may be used to isolate the improved PGA enzymes. For affinity chromatography purification, any antibody which specifically binds the PGA polypeptide may be used. For the production of antibodies, various host animals, including but not limited to rabbits, mice, rats, etc., may be immunized by injection with an engineered polypeptide. The polypeptide may be attached to a suitable carrier, such as BSA, by means of a side chain functional group or linkers attached to a side chain functional group. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (bacilli Calmette Guerin) and *Corynebacterium parvum*.

6.6. Method of Using the PGA Polypeptides

As described herein, PGA enzymes are useful for mediating the cleavage of penicillin G, also known a benzyl penicillin, of structure formula (I) to 6-amino penicillanic acid of structural formula (II) and phenylacetic acid of structural formula (III), as shown in Scheme 1.

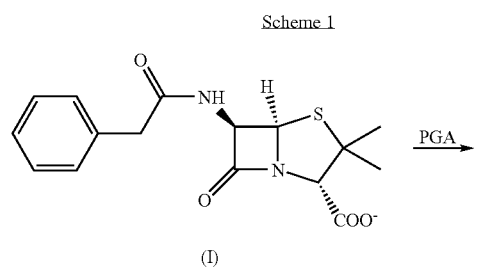

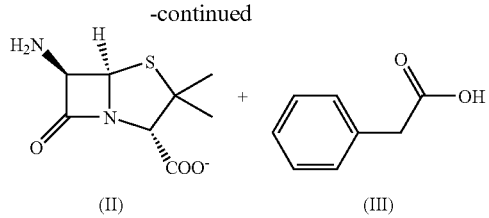

The 6-amino penicillanic acid is a key intermediate in the production of semi-synthetic β-lactam antibiotics such as amoxicillin, ampicillin and cephalexin. Accordingly, in some embodiments, the PGA polypeptides of the disclosure are can be used in a method for mediating cleavage of penicillin G (the substrate) to 6-amino penicillanic acid and phenylacetic acid (the "products"), which method comprises contacting the penicillin G with a PGA enzyme of the disclosure under reaction conditions suitable for cleaving the substrate to the product. In some embodiments, the PGA polypeptide used in the method comprises an A unit and a B unit, wherein the A-unit comprises an amino acid sequence having at least 85%, 86%, 87%, 88%, 89%, 90%, 91%, 92%, 93%, 94%, 95%, 96%, 97%, 98%, 99% or more identity to residues 560 to 764 of the engineered PGA of SEQ ID NO: 130 and the B-unit comprises an amino acid sequence having at least 85%, 86%, 87%, 88%, 89%, 90%, 91%, 92%, 93%, 94%, 95%, 96%, 97%, 98%, 99% or more identity to residues 1 to 555 of the engineered PGA of SEQ ID NO: 130, wherein the PGA polypeptide has improved enzymatic activity as compared to the naturally occurring PGA of *K. citrophila*.

In some embodiments of the method, the PGA polypeptide used in the method can comprise an α-chain amino acid sequence and a β-chain amino acid sequence that is at least about 85%, 86%, 87%, 88%, 89%, 90%, 91%, 92%, 93%, 94%, 95%, 96%, 97%, 98%, 99% or more identical to the respective α-chain and β-chain sequences of the reference sequences of any one of SEQ ID NO: 4, 6, 8, 10, 12, 14, 16, 18, 20, 22, 24, 26, 28, 30, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178.

In some embodiments of the method, the PGA polypeptides used in the method comprises a single chain PGA enzyme as described herein. In some embodiments, the single chain PGA comprises an amino acid sequence is at least about 85%, 86%, 87%, 88%, 89%, 90%, 91%, 92%, 93%, 94%, 95%, 96%, 97%, 98%, 99% or more identical to the sequence of any one of SEQ ID NO: 4, 6, 8, 10, 12, 14, 16, 18, 20, 22, 24, 26, 28, 30, 34, 36, 38, 40, 42, 44, 46, 48, 50, 52, 54, 56, 58, 60, 62, 64, 66, 68, 70, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, or 178.

In some embodiments, the PGA polypeptides of the disclosure can be used in condensation reactions for form various β-lactam antibiotics, as shown in Scheme 7:

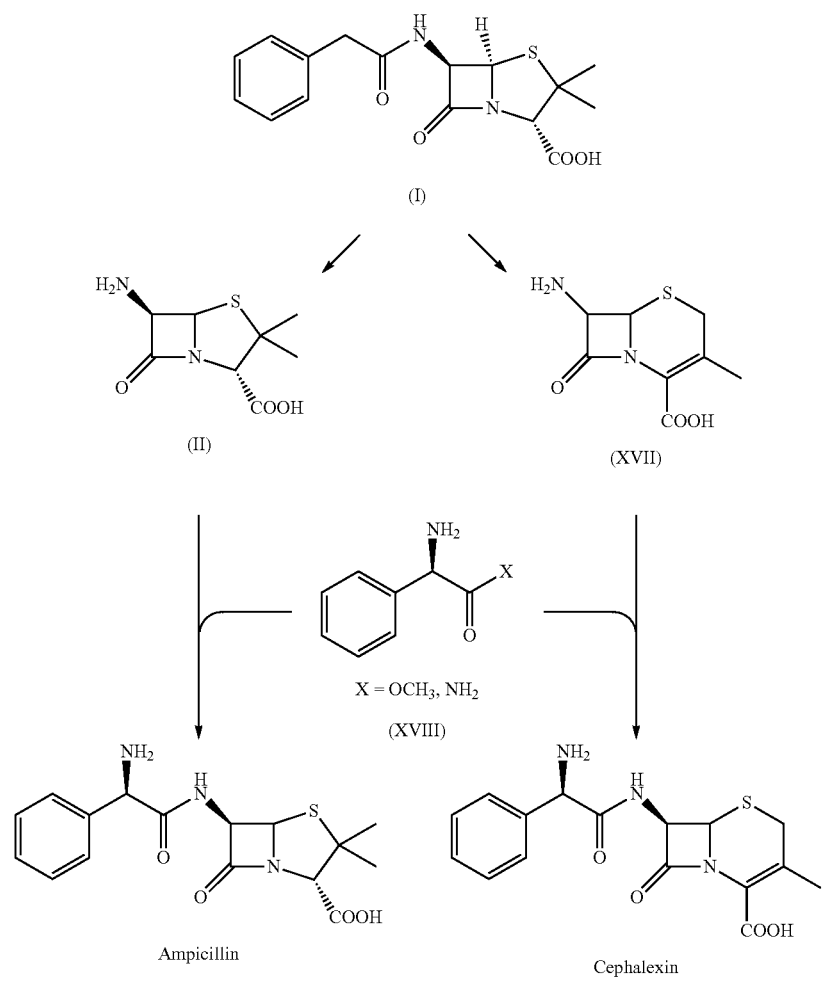

Scheme 7

In some embodiments for a method for synthesis of a β-lactam antibiotic, such as ampicillin or cephalexin, the method can comprise contacting a the compound of structural formula (II) or (XVII) with a PGA polypeptide with improved S/H ratio as compared to the naturally occurring *K citrophila* PGA. In some embodiments, the engineered PGA used in the method is based on the sequence formula of SEQ ID NO: 181, where the amino acid sequence has one or more of the following features: residue corresponding to X28 is a non-polar, aliphatic, or polar residue, particularly valine or threonine; residue corresponding to X71 is a cysteine, non-polar, aliphatic, or basic residue, particularly cysteine, glycine, lysine, or valine; residue corresponding to X547 is a basic or polar residue, particularly glutamine; and residue corresponding to X701 is a tyrosine. In some embodiments, the PGAs with improved S/H ratio can have, in addition, to the preceding features, one or more residue differences at other residue positions as compared to the α- and β-chain of SEQ ID NO:2. In some embodiments, the PGA polypeptide comprises a single chain PGA as described herein.

In some embodiments of the method for the condensation of the compound of structural formula (II) or (XVII) with the compound of structural formula (XVIII), the method can use the PGA polypeptide comprising an amino acid sequence corresponding to SEQ ID NO: 22, 24, 26, 82, or 84.

Other condensation reactions for synthesis of β-lactam type antibiotics will be apparent to the skilled artisan (see, e.g., Ulijn et al., 2002, *J Biotechnol.* 99, 215-222; Goncalves et al., 2002, *Biotechnology and Bioengineering* 80:622-631).

7. EXAMPLES

Various features and embodiments of the disclosure are illustrated in the following representative examples, which are intended to be illustrative, and not limiting.

Example 1

*E. coli* Expression Hosts Containing Recombinant PGA Genes

PGA-encoding genes were designed for expression in *E. coli* based on a codon optimization algorithm and synthesized using oligonucleotides, generally composed of 42 nucleotides. The PGA-encoding genes were cloned into the expression vector pCK110900 (depicted as FIG. 3 in United States Patent Application Publication 20060195947) operatively linked to the lac promoter under control of the lacI repressor. The expression vector also contains the P15a origin of replication and the chloramphenicol resistance gene. Resulting plasmids were transformed into *E. coli* W3110 using standard methods. Transformants were isolated by subjecting the cells to chloramphenicol selection.

Example 2

Preparation of PGA-Containing Wet Cell Pellets

*E. coli* cells containing recombinant PGA-encoding genes (e.g., the engineered PGAs of Table 2) from monoclonal colonies were inoculated into 180 μL Luria Bertani Broth (LB), 1% glucose and 30 μg/mL chloramphenicol (CAM) in the wells of 96 well shallow well microtiter plates. The cultures were grown overnight (ON) at 30° C., 200 rpm and 85% humidity. 20 μL of the cell cultures were then transferred into a 96 well deep well microtiter plates containing 390 mL Terrific Broth (TB) and 30 μg/mL CAM. The deep-well plates were incubated for 3.0 hours (OD600 0.6-0.8) at 30° C., 250 rpm and 85% humidity. The cell cultures were then induced by isopropyl thiogalactoside (IPTG) to a final concentration of 1 mM and incubated for overnight under the same conditions. The cells were then pelleted via centrifugation at 4000 rpm for 10 min.

Example 3

Preparation of PGA-Containing Cell Lysates 0.4 mL lysis buffer containing 50 mM potassium phosphate buffer, pH 7, 1 mg/mL Lysozyme, 0.5 mg/mL polymixin B sulfate (PMBS) was added to the cell paste in each well from the preceding Example. The cells were lysed at room temperature for 2 hours with shaking on a bench top shaker. The plate was then centrifuged for 10 min at 4000 rpm and 4° C. The clear supernatants were used to for biocatalytic reactions.

Example 4

Evaluation of Engineered PGA Enzymes for Increased Thermal and Solvent Stability Recombinant PGA cell lysates prepared as in Example 3 were preincubated in 50 mM phosphate buffer, pH 7, at 50-60° C. (for thermal stability) or at room temperature (RT) with added acetonitrile or methanol, in each case for ~18 hrs. The residual PGA activity was measured by addition of the preincubated crude lysates into a solution containing 0.2 mM 2-nitro-5-[(phenylacetyl)amino]benzoic acid (NIPAB) as substrate in 50 mM phosphate buffer, pH 7.0, at 22° C. The reaction was monitored continuously by measuring the hydrolysis of NIPAB at λmax=405 nm. Reaction rates were determined from the slopes of the initial linear portion of curves, where only a small percentage of the substrate was hydrolyzed. For each PGA-containing lysate, the activity in the lysate under the same conditions but without the preincubation was set at 100% for that PGA.

TABLE 3

Thermal and Solvent Stability of PGA variants

| SEQ ID NO. | No. of residue differences from SEQ ID NO: 32 | Preincubated at 50-60° C.[a] | Preincubated with 30% acetonitrile[b] | Preincubated with 48% methanol[b] |
|---|---|---|---|---|
| 2 | (wild type PGA) | ND | ND | ND |
| 32 | 0 | + | + | + |
| 4 | 3 | ++ | ++ | ++ |

ND = no detectable residual activity
[a] + = residual activity <60%; ++ = residual activity >60%
[b] + = residual activity <10%; ++ = residual activity >10%

Example 5

Evaluation of Engineered PGAs for Hydrolysis of NIPAB

The activity of engineered PGAs for hydrolysis of NIPAB was measured following the procedure described in Example 4, without the preincubations (i.e., without the thermal or solvent stability challenge conditions).

TABLE 4

Activity of PGA variants on NIPAB Substrate

| SEQ ID NO: | No. of Residue Differences from SEQ ID NO: 32 | Activity for hydrolysis of NIPAB |
|---|---|---|
| 2 | wt PGA | + |
| 4 | 3 | +++ |
| 6 | 3 | ++ |
| 8 | 3 | +++ |
| 10 | 4 | + |
| 16 | 4 | + |
| 20 | 4 | +++ |
| 22 | 4 | + |
| 24 | 4 | +++ |
| 26 | 4 | +++ |
| 28 | 4 | + |
| 30 | 4 | +++ |
| 32 | 0 | +++ |
| 46 | 4 | +++ |
| 48 | 4 | ++ |
| 50 | 4 | + |
| 52 | 4 | +++ |
| 54 | 4 | +++ |
| 56 | 4 | +++ |
| 58 | 4 | +++ |
| 60 | 3 | +++ |
| 62 | 4 | +++ |
| 64 | 5 | +++ |
| 70 | 3 | + |
| 72 | 3 | ++ |
| 74 | 3 | + |
| 76 | 3 | + |
| 82 | 3 | +++ |
| 84 | 3 | +++ |
| 86 | 4 | +++ |
| 88 | 3 | ++ |
| 90 | 5 | ++ |
| 96 | 5 | + |
| 98 | 5 | + |
| 100 | 7 | ++ |
| 120 | 6 | + |
| 148 | 5 | ++ |
| 162 | 5 | + |
| 166 | 5 | + |
| 170 | 5 | + |
| 172 | 6 | ++ |

+ = initial activity 1-1.5 times wt KC PGA
++ = initial activity 1.5-4 time wt KC PGA
+++ = initial activity >4 times wt KC PGA

Example 6

Evaluation of PGA Variants for Synthesis of N-Cyclohexyl-Phenylacetamide 0.5 mL of a solution containing 15 mM methyl phenylacetic acid and 30 mM cyclohexylamine in MTBE was added to wet centrifuged PGA cell pellets (prepared as in Example 2) in each well. The plate was sealed and incubated at room temperature overnight on a bench top shaker. 100 μL 5% phosphoric acid followed by 0.5 mL MTBE were added to each well. After shaking the plate for 10 min and centrifugation, 200 μL of the MTBE layer was transferred to a polypropylene shallow plate for GC analysis using an HP5 column; 30 m, 0.25 mm i.d., 0.25 μm df. Table 5 shows the ratio of the desired product N-cyclohexyl-phenylacetamide to the undesired hydrolysis product phenylacetic acid.

TABLE 5

| SEQ ID NO. | Amide Formation (Amide/Acid)[a] |
|---|---|
| 2 | + |
| 22 | ++ |
| 24 | +++ |
| 26 | +++ |
| 82 | +++ |
| 84 | ++ |

+ = amide to acid ratio <1.5
++ = amide to acid ratio 1.5-10
+++ = amide to acid ratio >10.

Example 7

Evaluation of Engineered PGA Enzymes for Hydrolysis of Para-Substituted Phenylacetic Acid Methyl Esters Activity of engineered PGAs (i.e., PGA variants) for the hydrolysis of three para-substituted phenylacetic acid methyl ester substrates was evaluated. The substrates were methyl 4-methoxyphenylacetate (Me 4MeOPhAc), methyl 4-hydroxyphenylacetate (Me 4HOPhAc), and methyl 4-chlorophenylacetate (Me₄ClPhAc).

0.5 mL of a solution containing 15 mM para-substituted phenylacetic acid methyl ester in MTBE was added to wet centrifuged cell pellets (prepared as in Example 2) in each well. Plate was sealed and incubated at room temperature overnight on a bench top shaker. 100 μL 5% phosphoric acid followed by 0.5 mL MTBE were added to each well. After shaking the plate for 10 min and centrifugation, 200 μL of the MTBE layer was transferred to a polypropylene shallow plate. These samples were analyzed by GC using an appropriate chiral and achiral column. Achiral column; HP5; 30 m, 0.25 mm ID, 0.25 df. Chiral column for methyl R,S-α-OMe phenylacetate: Resteck, RT-GammaDEXsa m, 0.25 mm i.d., 0.25 μm df. Chiral column for methyl R,S-α-OH phenylacetate, R,S-I-phenylethanol, R,S-I-phenylpropanol: Resteck, RT-BetaDEXsa m; 0.25 mm i.d., 0.25 lum df. Table 6 gives the % conversion of the methyl esters for PGA variants.

TABLE 6

Hydrolysis of para-substituted phenylacetic acid methyl esters

| SEQ ID NO. | Me 4MeOPhAc % Conversion[a] | Me 4HOPhAc % Conversion[b] | Me 4ClPhAc % Conversion[c] |
|---|---|---|---|
| 2 (wild-type) | + | + | + |
| 4 | + | + | + |
| 6 | ++ | ++ | + |
| 8 | | +++ | ++ |
| 10 | | ++ | + |
| 16 | +++ | ++ | +++ |
| 18 | | | |
| 20 | + | ++ | ++ |
| 22 | ++ | ++ | ++ |
| 24 | ++ | ++ | ++ |
| 26 | | | + |
| 30 | | ++ | ++ |
| 32 | + | | +++ |
| 34 | | ++ | ++ |
| 36 | | ++ | ++ |
| 38 | | ++ | + |
| 40 | | ++ | + |
| 42 | | ++ | + |
| 44 | | ++ | + |
| 46 | ++ | + | ++ |
| 48 | | ++ | + |
| 50 | | ++ | + |
| 52 | ++ | ++ | ++ |
| 54 | ++ | ++ | ++ |
| 56 | | ++ | + |
| 58 | | ++ | + |
| 60 | ++ | +++ | + |
| 62 | +++ | +++ | + |
| 64 | ++ | ++ | + |
| 66 | | | + |
| 70 | | + | + |
| 72 | | + | + |
| 74 | | + | ++ |
| 76 | | + | ++ |
| 78 | | ++ | ++ |
| 80 | | ++ | |
| 82 | | ++ | + |
| 84 | | ++ | + |
| 86 | | ++ | + |
| 88 | + | ++ | ++ |
| 90 | | +++ | ++ |
| 92 | | +++ | +++ |
| 96 | | | +++ |
| 98 | | +++ | +++ |
| 100 | | +++ | ++ |
| 102 | | | + |
| 104 | | | + |
| 106 | | | + |
| 108 | | | + |
| 110 | | | + |
| 112 | | | + |
| 124 | | | + |
| 126 | | | ++ |
| 128 | | | ++ |
| 130 | | | ++ |
| 132 | + | ++ | ++ |
| 134 | + | ++ | ++ |
| 136 | + | ++ | ++ |
| 138 | + | | |
| 142 | | +++ | ++ |
| 144 | ++ | +++ | ++ |
| 146 | ++ | ++ | ++ |
| 148 | ++ | ++ | ++ |
| 150 | ++ | ++ | +++ |
| 154 | | +++ | |
| 162 | ++ | +++ | +++ |
| 164 | + | | |
| 166 | ++ | ++ | + |
| 168 | +++ | +++ | +++ |
| 170 | +++ | +++ | +++ |

TABLE 6-continued

Hydrolysis of para-substituted phenylacetic acid methyl esters

| SEQ ID NO. | Me 4MeOPhAc % Conversion[a] | Me 4HOPhAc % Conversion[b] | Me 4ClPhAc % Conversion[c] |
|---|---|---|---|
| 172 | +++ | +++ | +++ |
| 176 | +++ | +++ | +++ |
| 178 | +++ | +++ | +++ |

[a] + = % conversion <15%; ++ = % conversion 15-50%; +++ = % conversion >50%
[b] + = % conversion <30%; ++ = % conversion 30-60%; +++ = % conversion >60%
[c] + = % conversion <20%; ++ = % conversion 20-40%; +++ = % conversion >40%

Example 8

Evaluation of Engineered PGA Enzymes for Hydrolysis of Methyl 2 Phenoxyacetate Activity of engineered PGA enzymes for the hydrolysis of methyl 2-phenoxy acetate (Me PhOAc) was evaluated. The procedure was identical to that described in Example 7 with the exception of the different substrate that was used. Table 7 gives the conversions of the methyl esters for PGA variants.

TABLE 7

Hydrolysis of methyl 2-phenoxyacetate.

| SEQ ID NO. | Me PhOAc Conversion* |
|---|---|
| 2(wild type) | + |
| 4 | ++ |
| 6 | +++ |
| 8 | +++ |
| 10 | ++ |
| 12 | ++ |
| 14 | + |
| 16 | +++ |
| 18 | + |
| 20 | ++ |
| 22 | ++ |
| 24 | ++ |
| 26 | + |
| 28 | + |
| 30 | ++ |
| 32 | +++ |
| 34 | ++ |
| 36 | ++ |
| 38 | ++ |
| 40 | ++ |
| 42 | ++ |
| 44 | ++ |
| 46 | +++ |
| 48 | ++ |
| 52 | ++ |
| 54 | ++ |
| 56 | +++ |
| 58 | +++ |
| 60 | +++ |
| 62 | ++ |
| 64 | ++ |
| 66 | + |
| 68 | ++ |
| 70 | ++ |
| 72 | ++ |
| 74 | ++ |
| 76 | ++ |
| 78 | ++ |
| 80 | ++ |
| 82 | + |
| 84 | + |
| 86 | + |
| 88 | ++ |
| 90 | + |
| 92 | +++ |
| 94 | ++ |
| 96 | ++ |
| 98 | ++ |
| 100 | ++ |
| 102 | ++ |
| 104 | ++ |
| 106 | ++ |
| 108 | ++ |
| 110 | + |
| 112 | ++ |
| 114 | ++ |
| 116 | ++ |
| 118 | ++ |
| 120 | +++ |
| 122 | ++ |
| 124 | ++ |
| 126 | ++ |
| 128 | ++ |
| 130 | ++ |
| 132 | ++ |
| 134 | + |
| 136 | + |
| 138 | ++ |
| 140 | ++ |
| 142 | ++ |
| 144 | ++ |
| 146 | ++ |
| 148 | +++ |
| 150 | +++ |
| 152 | +++ |
| 154 | |
| 156 | ++ |
| 158 | + |
| 160 | ++ |
| 162 | ++ |
| 164 | ++ |
| 166 | ++ |
| 168 | +++ |
| 170 | +++ |
| 172 | +++ |
| 174 | + |
| 176 | +++ |
| 178 | +++ |

+ = % conversion <10%;
++ = % conversion 10-20%;
+++ = % conversion >20%

Example 9

Evaluation of Engineered PGAs for Hydrolysis of Racemic α-Substituted Phenylacetic Acid Methyl Esters Activity of engineered PGA enzymes for the hydrolysis of three racemic α-substituted phenylacetic acid methyl ester substrates was evaluated. The procedure was identical to that of Example 7 with the exception of the different substrates used. The substrates were racemic methyl α-methyl 4-chlorophenylacetate (Me α-Me4ClPhAc), racemic methyl α-methyl-4-hydroxyphenylacetate (Me α-Me4HOPhAc), and racemic methyl α-methoxyphenylacetate (Me α-MeOPhAc). Table 8 gives the conversions of the methyl esters for PGA variants, and for Me α-Me4HOPhAc and Me α-MeOPhAc the stereospecificities in terms of the % enantiomeric excess (% e.e.) of the remaining unreacted methyl ester substrate.

TABLE 8

Hydrolyses of racemic α-substituted phenylacetic acid methyl esters.

| SEQ ID NO. | Me α-Me4ClPhAc Conversion[a] | Me α-Me4HOPhAc Conversion[b] | Stereospecificity[c] | Me α-MeOPhAc Conversion[d] | Stereospecificity[e] |
|---|---|---|---|---|---|
| 2(wild type) | ND | + | * | ND | − |
| 4 | + | ++ | ** | | |
| 6 | ++ | ++ | − | | |
| 8 | | + | − | | |
| 10 | | ++ | ** | | |
| 12 | | + | −− | ++ | ** |
| 14 | | + | −− | | |
| 16 | ++ | +++ | *** | | |
| 18 | | ++ | − | | |
| 20 | + | ++ | − | | |
| 22 | + | ++ | − | | |
| 24 | + | ++ | * | | |
| 30 | + | ++ | ** | | |
| 32 | ++ | +++ | ** | + | ** |
| 34 | + | ++ | −−− | | |
| 36 | | ++ | −− | | |
| 38 | | ++ | −− | | |
| 40 | | ++ | −− | + | *** |
| 42 | | ++ | − | + | −− |
| 44 | | ++ | − | | |
| 48 | | ++ | −− | | |
| 50 | | ++ | −− | | |
| 52 | + | | − | | |
| 54 | ++ | ++ | − | + | ** |
| 56 | | ++ | − | + | ** |
| 58 | | ++ | − | + | ** |
| 60 | + | ++ | − | | |
| 62 | | ++ | − | + | ** |
| 64 | | ++ | − | + | ** |
| 66 | + | + | −−− | | |
| 68 | + | + | −− | ++ | −− |
| 70 | + | + | −− | | |
| 72 | | ++ | −− | | |
| 74 | + | ++ | −− | ++ | −−− |
| 76 | + | ++ | −− | | −− |
| 78 | + | ++ | − | + | |
| 80 | | ++ | − | ++ | −− |
| 82 | | ++ | * | | |
| 84 | + | +++ | ** | | |
| 86 | + | ++ | ** | | |
| 88 | | +++ | ** | | |
| 90 | | + | * | | |
| 92 | | ++ | ** | | |
| 94 | | + | −− | | |
| 96 | | ++ | ** | | |
| 98 | | ++ | ** | | |
| 100 | | ++ | *** | | |
| 102 | | ++ | − | | |
| 106 | | + | − | | |
| 128 | ++ | | | | |
| 130 | + | | | | |
| 132 | + | ++ | * | | |
| 134 | + | + | ** | | |
| 136 | + | + | ** | | |
| 138 | | + | * | | |
| 142 | | +++ | *** | | |
| 144 | | ++ | *** | | |
| 146 | + | ++ | ** | | |
| 148 | ++ | + | ** | | |
| 150 | ++ | ++ | ** | | |
| 152 | | + | −− | ++ | ** |
| 154 | | + | ** | | |
| 156 | | ++ | −−− | +++ | *** |
| 158 | | ++ | −−− | | |
| 160 | | ++ | −−− | + | ** |
| 162 | + | +++ | *** | | |
| 164 | | ++ | *** | | |
| 166 | + | +++ | *** | | |
| 168 | + | +++ | *** | | |
| 170 | ++ | +++ | *** | | |
| 172 | + | +++ | *** | | |
| 174 | | ++ | ** | | |

TABLE 8-continued

Hydrolyses of racemic α-substituted phenylacetic acid methyl esters.

| SEQ ID NO. | Me α-Me4ClPhAc Conversion[a] | Me α-Me4HOPhAc Conversion[b] | Me α-Me4HOPhAc Stereospecificity[c] | Me α-MeOPhAc Conversion[d] | Me α-MeOPhAc Stereospecificity[e] |
|---|---|---|---|---|---|
| 176 | | +++ | *** | | |
| 178 | ++ | +++ | | | |

[a]Conversion: ND = not detectable; + = <3%; ++ = 3-5%.
[b]Conversion: + = <15%; ++ = 15-30%; +++ = >30%.
[c]% e.e. (S): * = <10%;  = 10-30%; * = >30% % e.e. (R): − = <10%; −− = 10-30%; −−− = >30%
[d]Conversion: ND = not detectable; + = <10%; ++ = 10-20%; +++ = >20%.
[e]% e.e. (S): * = <10%;  = 10-30%; * = >30%. % e.e. (R): − = <10%; −− = 10-30%; −−− = >30%.

Example 10

Evaluation of Engineered PGAs for Hydrolysis of Phenylacetic Acid Esters of Racemic 1-Chiral Alcohols Activity of engineered PGAs for the hydrolysis of three phenylacetic acid esters of racemic 1-chiral alcohols substrates was evaluated. The procedure was identical to that of Example 7 with the exception of the different substrates used. The substrates were racemic 1-phenylethyl2-phenylacetate (1PhEt-2PhAc), racemic 1-phenylethyl2-(4-chlorophenyl)acetate (1PhEt-2(4Cl)PhAc), racemic 1-phenylpropyl2-phenylacetate (1PhPr-2PhAc), and racemic 1-phenylpropyl2-(4-chlorophenyl)acetate (1PhPr-2(4Cl)PhAc). Table 9 gives the conversions of the esters for PGA variants and the stereospecificities in terms of the % enantiomeric excess (% e.e.) of the resulting chiral alcohol product.

TABLE 9

Hydrolyses of phenyl acetic acid esters of racemic 1-chral alcohols.

| SEQ ID NO. | 1PhEt-2PhAc[a] Conv. | 1PhEt-2PhAc[a] e.e. | 1PhEt-2(4Cl)PhAc[b] Conv. | 1PhEt-2(4Cl)PhAc[b] e.e. | 1PhPr-2PhAc[c] Conv. | 1PhPr-2PhAc[c] e.e. | 1PhPr-2(4Cl)PhAc[d] Conv. | 1PhPr-2(4Cl)PhAc[d] e.e. |
|---|---|---|---|---|---|---|---|---|
| 2 (wild type) | + | * | + | * | + | ** | + | *** |
| 4 | +++ | *** | +++ | *** | +++ | ** | ++ | ** |
| 6 | + | −−− | ++ | *** | | | | |
| 8 | +++ | *** | + | ** | ++ | ** | + | ** |
| 10 | ++ | *** | ++ | *** | ++ | *** | | |
| 12 | + | *** | + | *** | + | * | | |
| 14 | + | *** | + | *** | + | * | | |
| 16 | ++ | −−− | ++ | −−− | + | * | | |
| 20 | +++ | *** | +++ | *** | +++ | ** | +++ | ** |
| 22 | +++ | ** | +++ | ** | ++ | * | ++ | ** |
| 24 | +++ | ** | +++ | ** | +++ | ** | ++ | ** |
| 26 | + | *** | + | *** | + | * | | |
| 28 | + | *** | + | *** | | | | |
| 30 | + | *** | +++ | *** | ++ | ** | + | ** |
| 32 | +++ | *** | ++ | *** | ++ | *** | ++ | *** |
| 34 | +++ | *** | ++ | *** | +++ | *** | + | ** |
| 36 | + | *** | ++ | *** | + | ** | + | ** |
| 38 | ++ | *** | ++ | *** | ++ | ** | + | ** |
| 40 | +++ | *** | | | ++ | *** | + | ** |
| 42 | ++ | *** | + | −−− | ++ | *** | + | − |
| 44 | ++ | *** | +++ | *** | ++ | ** | ++ | ** |
| 46 | ++ | *** | ++ | *** | ++ | ** | + | ** |
| 48 | +++ | *** | ++ | *** | +++ | *** | + | ** |
| 50 | +++ | *** | + | ** | +++ | *** | + | ** |
| 52 | +++ | *** | + | *** | ++ | *** | + | *** |
| 54 | +++ | *** | +++ | ** | +++ | *** | ++ | *** |
| 56 | +++ | *** | ++ | *** | ++ | *** | ++ | ** |
| 58 | ++ | *** | +++ | *** | ++ | ** | ++ | *** |
| 60 | +++ | *** | +++ | *** | +++ | *** | +++ | ** |
| 62 | +++ | *** | +++ | *** | +++ | *** | + | ** |
| 64 | +++ | *** | +++ | ** | +++ | *** | + | ** |
| 66 | + | *** | + | * | + | * | + | * |
| 68 | + | ** | ++ | ** | + | * | + | * |
| 70 | ++ | ** | ++ | ** | + | * | + | ** |
| 72 | ++ | ** | ++ | *** | + | * | | |
| 74 | ++ | ** | + | ** | + | ** | | |
| 76 | + | *** | + | *** | + | * | | |
| 78 | | | | | + | ** | + | * |

TABLE 9-continued

Hydrolyses of phenyl acetic acid esters of racemic 1-chral alcohols.

| SEQ ID NO. | 1PhEt-2PhAc[a] | | 1PhEt-2(4Cl)PhAc[b] | | 1PhPr-2PhAc[c] | | 1PhPr-2(4Cl)PhAc[d] | |
|---|---|---|---|---|---|---|---|---|
| | Conv. | e.e. | Conv. | e.e. | Conv. | e.e. | Conv. | e.e. |
| 80 | + | ** | | | + | * | | |
| 82 | +++ | ** | +++ | *** | ++ | * | + | ** |
| 84 | +++ | *** | ++ | *** | ++ | *** | + | ** |
| 86 | +++ | *** | +++ | *** | ++ | ** | ++ | ** |
| 88 | +++ | *** | ++ | *** | ++ | ** | ++ | ** |
| 94 | + | *** | | | | | | |
| 142 | + | --- | | | | | | |
| 146 | + | --- | | | | | | |
| 148 | + | --- | | | | | | |
| 152 | | | | | ++ | * | | |
| 154 | + | --- | | | | | | |
| 156 | | | | | ++ | ** | + | * |
| 158 | | | | | + | * | | |
| 160 | + | *** | | | | | | |
| 162 | + | -- | | | | | | |
| 164 | + | --- | | | | | | |
| 174 | + | --- | | | | | | |

[a]Conversion: + = <20%; ++ = 20-40%; +++ = >40% % e.e. (R): * = <20%;  = 20-50%; * >50% % e.e. (S): - = <20%; -- = 20-50%; --- = >50%
[b]% conversion + = <15%; ++ = % conversion 15-30%; +++ = >30% % e.e. (R): * = <20%;  = 20-50%; * >50% % e.e. (S): - = <20%; -- = 20-50%; --- = >50%
[c]% conversion + = <10%; ++ = 10-30%; +++ = >30% % e.e. (R): * = <80%;  = 80-92%; * = >92%
[d]% conversion + = <10%; ++ = 10-20%; +++ = >20% % e.e. (R): * = <50%;  = 50-90%; * = >90% % e.e. (S): - = <20%

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (181 sequences)

SEQ ID NO: 1 - DNA, 2541 bp, Kluyvera citrophila
atgaaaaatagaaatcgtatgatcgtgaacggtattgtgacttccctgatctgttgttctagcctgtcagcgctggcggcaagcccgccaaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccggttttctgacagcaccagcgaaattgataacctggcgctgctgacggcgctaaaagataaatacggcaagcagcagggcatggcggtctttaaccagctgaaatggctggttaatccttccgcgccaaccaccattgcggcgcgggaaagcgcctatccgctgaagtttgatctgcaaaacacgcaaacggcggcgctgctgccgcgctacgaccagccggcaccgatgctcgaccgcccggcaaaagggaccgatggcgcgctgctggcgctgaccgccgatcagaaccgggaaactatcgccgcgcagttcgcgcaaagcggcgctaacggcctggctggctacccgaccactagcaatatgtgggtgattggcaaaaacaaagcccaggatgcgaaggccattatggtcaatgggccgcagtttggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttttggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggcaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtgatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagcgctaa

SEQ ID NO: 2 - protein, 846 aa, Kluyvera citrophila
MKNRNRMIVNGIVTSLICCSSLSALAASPPTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTAALLPRYDQPAPMLDRPAKGTDGALLALTADQNRETIAAQFAQSGANGLAGYPTTSNMWVIGKNKAQDAKAIMVNGPQFGWYAPAYTYGIGLHGAGYDVTGNTPFAYPGLVFGHNGTISWGSTAGFGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQR

SEQ ID NO: 3 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 4 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 5 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 6 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 7 - DNA, 2295 bp, Artificial Sequence
  Variant of single chain K. citrophila PGA
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 8 - protein, 764 aa, Artificial Sequence
  Variant of single chain K. citrophila PGA
SNMWVIGKNKAQDAKAIMVNGPQYGWYAPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 9 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgctcgccagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 10 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDARQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 11 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtctgtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 12 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRLSDSTSEIDNLALLTALKDKYGKQQGMAVFNQLKWLVNPSAPTTIAARESAYPLKFDLQNTQTA

SEQ ID NO: 13 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtgcgtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 14 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRASDSTSEIDNLALLTALKDKYGKQQGMAVFNQLKWLVNPSAPTTIAARESAYPLKFDLQNTQTA

SEQ ID NO: 15 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 16 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 17 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 18 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 19 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtctgggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 20 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGLGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 21 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgtgggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 22 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGVGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 23 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttgtggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 24 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 25 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtaaaggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 26 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGKGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 27 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcgtggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 28 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGRGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 29 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgaaggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 30 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGEGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 31 - DNA, 2295 bp, Artificial Sequence
  Single chain K. citrophila PGA
agcaatatgtgggtgattggcaaaaacaaagcccaggatgcgaaggccattatggtcaatgggccgcagtttggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttttggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggcaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtgatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagataaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 32 - protein, 764 aa, Artificial Sequence
  Single chain K. citrophila PGA
SNMWVIGKNKAQDAKAIMVNGPQFGWYAPAYTYGIGLHGAGYDVTGNTPFAYPGLVFGHNGTISWGSTAGFGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 33 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtgtttctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 34 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRVSDSTSEIDNLALLTALKDKYGKQQGMAVFNQLKWLVNPSAPTTIAARESAYPLKFDLQNTQTA

SEQ ID NO: 35 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtcattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 36 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRHSDSTSEIDNLALLTALKDKYGKQQGMAVFNQLKWLVNPSAPTTIAARESAYPLKFDLQNTQTA

SEQ ID NO: 37 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttgttctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 38 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRCSDSTSEIDNLALLTALKDKYGKQQGMAVFNQLKWLVNPSAPTTIAARESAYPLKFDLQNTQTA

SEQ ID NO: 39 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtatttctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 40 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRISDSTSEIDNLALLTALKDKYGKQQGMAVFNQLKWLVNPSAPTTIAARESAYPLKFDLQNTQTA

SEQ ID NO: 41 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtatgtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 42 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRMSDSTSEIDNLALLTALKDKYGKQQGMAVFNQLKWLVNPSAPTTIAARESAYPLKFDLQNTQTA

SEQ ID NO: 43 - DNA, 2295 bp, Artificial Sequence; identical to SEQ ID NO: 33
  Variant of single chain K. citrophila PGA

SEQ ID NO: 44 - protein, 764 aa, Artificial Sequence; identical to SEQ ID NO: 34
  Variant of single chain K. citrophila PGA

SEQ ID NO: 45 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccctggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 46 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRFSDSTSEIDNLALLTALKDKYGKQQGMAVFNQLKWLVNPSAPTTIAARESAYPLKFDLQNTQTA

SEQ ID NO: 47 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcacctttgcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 48 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTFANRFSDSTSEIDNLALLTALKDKYGKQQGMAVFNQLKWLVNPSAPTTIAARESAYPLKFDLQNTQTA

SEQ ID NO: 49 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccggggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 50 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTGANRFSDSTSEIDNLALLTALKDKYGKQQGMAVFNQLKWLVNPSAPTTIAARESAYPLKFDLQNTQTA

SEQ ID NO: 51 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 52 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 53 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcatttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 54 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 55 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcctgtttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 56 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 57 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccactaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 58 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTTNWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 59 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctactggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 60 - protein, 764 aa, Artificial Sequence; identical to SEQ ID NO: 4
  Variant of single chain K. citrophila PGA

SEQ ID NO: 61 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctactggcgtttacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 62 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAFTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 63 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctactggcgtttacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgccgaagtttgatctgcaaaacacgcaaacggcgtaa

SEQ ID NO: 64 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAFTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPPKFDLQNTQTA

SEQ ID NO: 65 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgcgccggcgtttacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 66 - protein, 764 aa, Artificial Sequence
  Variant of single chain K. citrophila PGA
SNMWVIGKNKAQDAKAIMVNGPQFGWYAPAFTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 67 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgcgccggcgttgacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 68 - protein, 764 aa, Artificial Sequence
  Variant of single chain K. citrophila PGA
SNMWVIGKNKAQDAKAIMVNGPQFGWYAPALTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 69 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgcgccggcggtgacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 70 - protein, 764 aa, Artificial Sequence
  Variant of single chain K. citrophila PGA
SNMWVIGKNKAQDAKAIMVNGPQFGWYAPAVTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 71 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgcgccggcgactacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 72 - protein, 764 aa, Artificial Sequence
  Variant of single chain K. citrophila PGA
SNMWVIGKNKAQDAKAIMVNGPQFGWYAPATTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 73 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgcgccggcgtgtacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 74 - protein, 764 aa, Artificial Sequence
  Variant of single chain K. citrophila PGA
SNMWVIGKNKAQDAKAIMVNGPQFGWYAPACTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 75 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgcgccggcgaatacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 76 - protein, 764 aa, Artificial Sequence
  Variant of single chain K. citrophila PGA
SNMWVIGKNKAQDAKAIMVNGPQFGWYAPANTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 77 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgcgccggcgatgacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 78 - protein, 764 aa, Artificial Sequence
  Variant of single chain K. citrophila PGA
SNMWVIGKNKAQDAKAIMVNGPQFGWYAPAMTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 79 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgcgccggcgaagacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 80 - protein, 764 aa, Artificial Sequence
  Variant of single chain K. citrophila PGA
SNMWVIGKNKAQDAKAIMVNGPQFGWYAPAKTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 81 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttgtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 82 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGCGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 83 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 84 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 85 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcagggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggtcggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 86 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGQGDDVDIFAEKLSAEKPGYYQHNGEWVKMLSRKETIAVKDGQPETFTVWRTLHGNVIKTDTATQTAYAKARAWDGKEVASLLAWTHQMKAKNWSEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 87 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 88 - protein, 764 aa, Artificial Sequence; identical to SEQ ID NO: 84
  Variant of single chain K. citrophila PGA

SEQ ID NO: 89 - DNA, 2295 bp, Artificial Sequence
  Variant of single chain K. citrophila PGA
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 90 - protein, 764 aa, Artificial Sequence
  Variant of single chain K. citrophila PGA
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 91 - DNA, 2295 bp, Artificial Sequence
  Variant of single chain K. citrophila PGA
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccacgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccgcccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 92 - protein, 764 aa, Artificial Sequence
  Variant of single chain K. citrophila PGA
SNMWVIGKNKAQDAKAIMVNGPQYGWYAPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATTNLAENDPRRQLVDKLASWDGENLVNDDGKTYQQPGSAILNAWLTSMLKRTVVAAVPAPFGKWYSASGYETAQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 93 - DNA, 2295 bp, Artificial Sequence
  Variant of single chain K. citrophila PGA
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtgaataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtcattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 94 - protein, 764 aa, Artificial Sequence
  Variant of single chain K. citrophila PGA
SNMWVIGKNKAQDAKAIMVNGPQYGWYAPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVNKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRHSDSTSEIDNLALLTALKDKYGKQQGMAVFNQLKWLVNPSAPTTIAARESAYPLKFDLQNTQTA

SEQ ID NO: 95 - DNA, 2295 bp, Artificial Sequence
  Variant of single chain K. citrophila PGA
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggcctataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 96 - protein, 764 aa, Artificial Sequence
  Variant of single chain K. citrophila PGA
SNMWVIGKNKAQDAKAIMVNGPQYGWYAPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRAYNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 97 - DNA, 2295 bp, Artificial Sequence
  Variant of single chain K. citrophila PGA
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcacaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 98 - protein, 764 aa, Artificial Sequence
  Variant of single chain K. citrophila PGA
SNMWVIGKNKAQDAKAIMVNGPQYGWYAPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 99 - DNA, 2295 bp, Artificial Sequence
  Variant of single chain K. citrophila PGA
agcaatatgtgggtgattggcaaaaacaaagcccaggatgcgaaggccattatggtcaatggaccgcagtatggttggtgtacgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcgttctttaaccagctgaaatggctggttaatccttccgcgccaaccaccattgcggcgcgggaaagcgcctatccgctgaagtttgatctgcaaaacacgcaaacggcgtaa

SEQ ID NO: 100 - protein, 764 aa, Artificial Sequence
  Variant of single chain K. citrophila PGA
SNMWVIGKNKAQDAKAIMVNGPQYGWCTPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAFFNQLKWLVNPSAPTTIAARESAYPLKFDLQNTQTA

SEQ ID NO: 101 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcataa

SEQ ID NO: 102 - protein, 764 aa, Artificial Sequence
  Variant of single chain K. citrophila PGA
SNMWVIGKNKAQDAKAIMVNGPQAGWYVPAWTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 103 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 104 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 105 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtgtacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggcccgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 106 - protein, 764 aa, Artificial Sequence
  Variant of single chain K. citrophila PGA
SNMWVIGKNKAQDAKAIMVNGPQAGWYVPACTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGPLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 107 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 108 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 109 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgtcggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgtccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaagcgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 110 - protein, 764 aa, Artificial Sequence
  Variant of single chain K. citrophila PGA
SNMWVIGKNKAQDAKAIMVNGPQAGWYVSAYTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLSSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTESDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 111 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatgtgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 112 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDVNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 113 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgtgctactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaggcgcctatccgctgaagtttgatctgcaaaacacgcaaacggcgtaa

SEQ ID NO: 114 - protein, 764 aa, Artificial Sequence
  Variant of single chain K. citrophila PGA
SNMWVIGKNKAQDAKAIMVNGPQAGWYVPAWTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRATEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAAREGAYPLKFDLQNTQTA

SEQ ID NO: 115 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 116 - protein, 764 aa, Artificial Sequence
  Variant of single chain K. citrophila PGA
SNMWVIGKNKAQDAKAIMVNGPQAGWYVPAWTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 117 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcggcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgggggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 118 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYRQPGSAILNAWLTSMLKRTVVAAVPAPFGKWYSASGYETTQDGPTGSLNISGGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 119 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctacaaaacacgcaaacggcgtaa

SEQ ID NO: 120 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENNMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 121 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 122 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 123 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 124 - protein, 764 aa, Artificial Sequence
  Variant of single chain K. citrophila PGA
SNMWVIGKNKAQDAKAIMVNGPQAGWYVPAWTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 125 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgttcacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacggtcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccttagcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 126 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAFTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTVLDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRFSDSTSEIDNLALLTALKDKYGKQQGMAVFNQLKWLVNPSAPTTIAARESAYPLKFDLQNTQTA

SEQ ID NO: 127 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgcacacctacggtatcggcctgcacggcgcgggctatgacgtcaccggcaatacgccgtttgcctatccgggcctcatctttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttctctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 128 - protein, 764 aa, Artificial Sequence
  Variant of single chain K. citrophila PGA
SNMWVIGKNKAQDAKAIMVNGPQAGWYVPAHTYGIGLHGAGYDVTGNTPFAYPGLIFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 129 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgttaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcagaaaacgatccgcgccgccaactggtggataaactggctagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcacctttgcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 130 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTFANRWSDSTSEIDNLALLTALKDKYGKQQGMAVFNQLKWLVNPSAPTTIAARESAYPLKFDLQNTQTA

SEQ ID NO: 131 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaaccgtaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggtaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 132 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANRNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 133 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 134 - protein, 764 aa, Artificial Sequence
  Variant of single chain K. citrophila PGA
SNMWVIGKNKAQDAKAIMVNGPQAGWYVPAWTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 135 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcacatttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgtgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctattccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 136 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLTFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 137 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 138 - protein, 764 aa, Artificial Sequence
  Variant of single chain K. citrophila PGA
SNMWVIGKNKAQDAKAIMVNGPQAGWYVPAYTYGIGLHGAGYDVTGNTPFAYPGLVFGHNGTISWGSTAGLGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 139 - DNA, 2295 bp, Artificial Sequence
  Variant of single chain K. citrophila PGA
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccttagcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 140 - protein, 764 aa, Artificial Sequence
  Variant of single chain K. citrophila PGA
SNMWVIGKNKAQDAKAIMVNGPQAGWYVPAWTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRFSDSTSEIDNLALLTALKDKYGKQQGMAVFNQLKWLVNPSAPTTIAARESAYPLKFDLQNTQTA

SEQ ID NO: 141 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatacctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 142 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLLFGHNGTISWGSTAGFGDGVDTFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 143 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggtggcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 144 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLTFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 145 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctatggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccactgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccttagcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 146 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRYSDSTSEIDNLALLTALKDKYGKQQGMAVFNQLKWLVNPSAPTTIAARESAYPLKFDLQNTQTA

SEQ ID NO: 147 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttgttatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 148 - protein, 764 aa, Artificial Sequence
  Variant of single chain K. citrophila PGA
SNMWVIGKNKAQDAKAIMVNGPQFGCYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 149 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgcggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 150 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNARIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 151 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggtggcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtatctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 152 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLTFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRISDSTSEIDNLALLTALKDKYGKQQGMAVFNQLKWLVNPSAPTTIAARESAYPLKFDLQNTQTA

SEQ ID NO: 153 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcagccggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattccattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcacctttgcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 154 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQPVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTFANRWSDSTSEIDNLALLTALKDKYGKQQGMAVFNQLKWLVNPSAPTTIAARESAYPLKFDLQNTQTA

SEQ ID NO: 155 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggatagactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccttagcgaaccgtgtctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 156 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDRLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRVSDSTSEIDNLALLTALKDKYGKQQGMAVFNQLKWLVNPSAPTTIAARESAYPLKFDLQNTQTA

SEQ ID NO: 157 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttactttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtcattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 158 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRHSDSTSEIDNLALLTALKDKYGKQQGMAVFNQLKWLVNPSAPTTIAARESAYPLKFDLQNTQTA

SEQ ID NO: 159 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtgtacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtcattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 160 - protein, 764 aa, Artificial Sequence
  Variant of single chain K. citrophila PGA
SNMWVIGKNKAQDAKAIMVNGPQFGWYVPACTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRHSDSTSEIDNLALLTALKDKYGKQQGMAVFNQLKWLVNPSAPTTIAARESAYPLKFDLQNTQTA

SEQ ID NO: 161 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 162 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 163 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaagccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttttcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 164 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKADTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFFAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 165 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctggaatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 166 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWNVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 167 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataaccaggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 168 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNQALLTALKDKYGKQQGMAVFNQLKWLVNPSAPTTIAARESAYPLKFDLQNTQTA

SEQ ID NO: 169 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaacactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 170 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVTLAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 171 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgttcacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 172 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAFTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 173 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgttaggcgcacgctgcacggcaacgtcattaaaaccgatactgcgacgcagaccgcctatgccaaagcgcgcgcctgggatggcgaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 174 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLLFGHNGTISWGSTAGFGDGVDIFAEKLSAEKPGYYQHNGEWVKMLSRKETIAVKDGQPETFTVRRTLHGNVIKTDTATQTAYAKARAWDGEEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 175 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaagatgtacgagagctttggccgtaaatcgctgtggttaacgccccaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccttagcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 176 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRWSDSTSEIDNLALLTALKDKYGKQQGMAVFNQLKWLVNPSAPTTIAARESAYPLKFDLQNTQTA

SEQ ID NO: 177 - DNA, 2295 bp, Artificial Sequence
  Variant of single chain K. citrophila PGA
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 178 - protein, 764 aa, Artificial Sequence
  Variant of single chain K. citrophila PGA
SNMWVIGKNKAQDAKAIMVNGPQFGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 179 - protein, 209 aa, Artificial Sequence
  alpha chain of K. citrophila PGA
ASPPTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 180 - protein, 557 aa, Artificial Sequence
  beta chain of K. citrophila PGA
SNMWVIGKNKAQDAKAIMVNGPQFGWYAPAYTYGIGLHGAGYDVTGNTPFAYPGLVFGHNGTISWGSTAGFGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQR

SEQ ID NO: 181 - protein, 764 aa, Artificial Sequence
  Single chain K. citrophila PGA Synthetic construct
  MISC_FEATURE (24)..(24): Xaa is an aromatic, non-polar or aliphatic residue
  MISC_FEATURE (26)..(26): Xaa is a cysteine or aromatic residue
  MISC_FEATURE (27)..(27): Xaa is a cysteine or an aromatic residue
  MISC_FEATURE (28)..(28): Xaa is a non-polar, aliphatic, or polar residue
  MISC_FEATURE (29)..(29): Xaa is a constrained or polar residue
  MISC_FEATURE (31)..(31): Xaa is a cysteine, constrained, aromatic, non-polar, aliphatic, polar, or basic residue
  MISC_FEATURE (56)..(56): Xaa is a non-polar, aliphatic or polar residue
  MISC_FEATURE (71)..(71): Xaa is a cysteine, basic, acidic, aromatic, non-polar, aliphatic, or polar residue
  MISC_FEATURE (74)..(74): Xaa is an acidic, non-polar, or aliphatic residue
  MISC_FEATURE (77)..(77): Xaa is a non-polar or aliphatic residue
  MISC_FEATURE (119)..(119): Xaa is an aromatic or basic residue
  MISC_FEATURE (129)..(129): Xaa is a polar, non-polar or aliphatic residue
  MISC_FEATURE (146)..(146): Xaa is a basic or acidic residue
  MISC_FEATURE (154)..(154): Xaa is an aromatic residue
  MISC_FEATURE (164)..(164): Xaa is a constrained or polar residue
  MISC_FEATURE (177)..(177): Xaa is a non-polar or polar residue
  MISC_FEATURE (225)..(225): Xaa is a non-polar or aliphatic residue
  MISC_FEATURE (240)..(240): Xaa is an aromatic or basic residue
  MISC_FEATURE (264)..(264): Xaa is an aromatic or basic residue
  MISC_FEATURE (270)..(270): Xaa is a non-polar or aliphatic residue
  MISC_FEATURE (308)..(308): Xaa is a non-polar, aliphatic, or polar residue
  MISC_FEATURE (321)..(321): Xaa is a polar or acidic residue
  MISC_FEATURE (322)..(322): Xaa is a basic residue
  MISC_FEATURE (340)..(340): Xaa is a polar or basic residue
  MISC_FEATURE (352)..(352): Xaa is a polar residue
  MISC_FEATURE (379)..(379): Xaa is a polar, non-polar or aliphatic residue
  MISC_FEATURE (386)..(386): Xaa is a polar or constrained residue
  MISC_FEATURE (391)..(391): Xaa is a non-polar or aliphatic residue
  MISC_FEATURE (410)..(410): Xaa is a non-polar, aliphatic or constrained residue
  MISC_FEATURE (423)..(423): Xaa is a non-polar, aliphatic or polar residue
  MISC_FEATURE (431)..(431): Xaa is an aromatic or basic residue
  MISC_FEATURE (457)..(457): Xaa is an aromatic or polar residue
  MISC_FEATURE (483)..(483): Xaa is a polar residue
  MISC_FEATURE (484)..(484): Xaa is a polar or acidic residue
  MISC_FEATURE (501)..(501): Xaa is a polar or acidic residue
  MISC_FEATURE (511)..(511): Xaa is a non-polar, aliphatic, or aromatic residue
  MISC_FEATURE (547)..(547): Xaa is a basic or polar residue
  MISC_FEATURE (658)..(658): Xaa is an aromatic or basic residue
  MISC_FEATURE (697)..(697): Xaa is a non-polar, aliphatic, or aromatic residue
  MISC_FEATURE (701)..(701): Xaa is a cysteine, aromatic, constrained, non-polar, aliphatic, or polar residue
  MISC_FEATURE (711)..(711): Xaa is a non-polar, aliphatic or polar residue
  MISC_FEATURE (729)..(729): Xaa is a non-polar, aliphatic, or aromatic residue
  MISC_FEATURE (750)..(750): Xaa is a non-polar, aliphatic or polar residue
  MISC_FEATURE (754)..(754): Xaa is a non-polar, aliphatic or constrained residue
SNMWVIGKNKAQDAKAIMVNGPQXGXXXXAXTYGIGLHGAGYDVTGNTPFAYPGLXFGHNGTISWGSTAGXGDXVDXFAEKLSAEKPGYYQHNGEWVKMLSRKETIAVKDGQPETFTVXRTLHGNVIKXDTATQTAYAKARAWDGXEVASLLAXTHQMKAKNWXEWTQQAAKQALTXNWYYADVNGNIGYVHTGAYPDRQPGHDPRLPVPGTGKWDWKGLLSFDXNPKVYNPQSGYIANXNNSPQKDYPASDLFAFLWGGADRXTEIDTXLDKQPRFTADQAWDVIRQTSRRDLNLRLFLPALKDATXNLAENDPRRQLVXXLASWDGENLVNDDGKTYXQPGSAILNAWLXSMLKRTVVAAVPAPFGKWYSASGYETXQDGPTGXLNISXGAKILYEALQGDKSPIPQXVDLFGGKPQQEVXLAALDDAXQTLSKRYGNDVTGWKTPAMALTFRAXNFFGVPQAAAKEARHQAEYQNRGTEXXMIVFSPTSGNRPVLAWXVVAPGQSGFXAPDGKADKHYDDQLKMYESFGRKSLWLTPQDVDEHXESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAXIDKVNASPDKLLPQQFSTFGFKPKHWEPFDVAMIFVGTXANRXSDSTSEIDNXALLTALKDKYGKQQGMAXFNQLKWLVNPSAPTTIAAREXAYPXKFDLQNTQTA

What is claimed is:

1. An engineered penicillin G acylase (PGA) capable of cleaving substrate 6-nitro-3-(phenylacetamido)benzoic acid (NIPAB) to product 5-amino-2-nitrobenzoic acid, wherein the PGA comprises an α-chain sequence having at least 85% identity to SEQ ID NO:179 and an β-chain sequence having at least 85% identity to SEQ ID NO:180, wherein the polypeptide has improved activity as compared to the naturally occurring PGA of Kluyvera citrophila, wherein said engineered penicillin G acylase comprises SEQ ID NO:8.

2. A polynucleotide encoding the engineered PGA of claim 1, wherein said polynucleotide sequence comprises SEQ ID NO:7.

3. An expression vector comprising the polynucleotide of claim 2.

4. A host cell comprising the vector of claim 3.

5. A method for cleaving penicillin G of structural formula (I) ("the substrate") to 6-amino penicillanic acid of structural formula (II) and phenylacetic acid of structural formula (III) ("the products"):

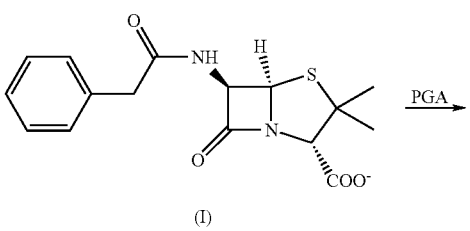

(I)

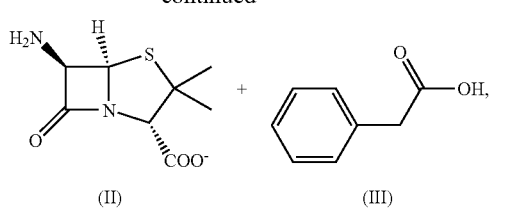

(II)  (III)

which method comprises:
contacting the penicillin G with an engineered PGA of claim 1, under reaction conditions suitable for cleaving the substrate to the products.

6. A composition comprising: (i) a penicillin G of structural formula (I), a 6-amino penicillanic acid of structural formula (II), and/or a phenylacetic acid of structural formula (III); and (ii) an engineered PGA comprising SEQ ID NO: 8.

* * * * *

UNITED STATES PATENT AND TRADEMARK OFFICE
CERTIFICATE OF CORRECTION

PATENT NO. : 8,247,192 B2
APPLICATION NO. : 12/615139
DATED : August 21, 2012
INVENTOR(S) : Behnaz Behrouzian et al.

Page 1 of 1

It is certified that error appears in the above-identified patent and that said Letters Patent is hereby corrected as shown below:

On the Title page, under Item (73) in the Assignee's City of Residence, please delete "Redwood" and insert --Redwood City--.

Signed and Sealed this
Sixteenth Day of October, 2012

David J. Kappos
*Director of the United States Patent and Trademark Office*